United States Patent 9,719,064 (GENOMICS OF ACTINOPLANES UTAHENSIS) - sequence listing, part 7

SEQ ID NO: 16053 - DNA, 9087635 bp, Actinoplanes utahensis (residues 1,817,528-3,635,054 of 9,087,635)
tacgcacagcactgagggcactgcggtgacgcgcgcacccccgattcgagaaggagcgtccgaggatgacggtggacccggcggtactcgacgagctcggccgcctgcgcagcagggtgcccgagctgtccggcagcgtgctcgccaccgccgacgggctggtcgtcgcgcatgattcgcacgggatcgaaccggacaccctggccgccctggccgcggcacacctggcgctggcgcgccggttcgcccacgcggtcaaccacggcgagctgcgggagtcggtcgtcgagtgcgacggcggctatatcacctcgtacaccgcgggccccaacgcgctgctcaccgtggtcacctccggcgacgcgaacctcgccatggtgcacctggaggcgcgacggtgcgtacgccggatcgtcaagctcctggctctggactcggcgcagcagaaacatctgcgtccggagattccgcagcagaccggaccgtcgtcgatcccgctggcccggcggaccccgatggccaccctgtcgaacgcgtcgcgccgccgcacggcggccggctgaccggcagagcatcaccgcggcgaccgccgcgcccttaccggcaccgccgttcccgggcgggccatcccaccacacaacggaggaccgaatcccatggctgacatggacaccgcactgaaggaagttatggagatcgacggctgcatcggcgtcgctctcgtcgaccacaccagcggcatggccctgggcaccctcggcggcggcaaggacctcgacctgacggtcgccgcggccggcaacaccgacgtggtgcgcgccaagctgcgggcgatggagatgctcaacctgaccgagaagatcgaggacatcctgatcaccctggacacgcagtaccacatgatccggccgctcacgagccgacagggcaagggcctgttcctgtacgtggcgctgcgccgggaccggtcgaacctggccatggcccggcatcagctgcgacgcatcgagaacgacctcgacgtctgacccgtgatcgccacccctggcggggagggtccgcaccaccctccccgccgcactaactagcatctgcagacatgccggccagggagatcgtcgaacgcgtccgggccggagaactcgatcatgagacggccctcgatatgctgaccggggcgcccgcggcggagaccgacgcggcactcgcggaagcgctgggcgccgagttcgaccggctgttccgcaccggttggcagccgatcgagctgcaccggacgatcgcgcggcgcggtgatccgatccagggccgcctggtggccgaggcggcggccgccttcctggtcggcaaggcaccggtcgacgaggcctggcgggcccaggtcgtacagctccagcggggtgcgggccggaagaaggacgaccggatcgcggtgctcgacgcctcgctcgggctgctcgacgagctgcgccggctgccgggcatcgagatcctcatcccgccgcccggcaccccggccaccaccgtgcatcagcacgccgaccggcggctgctcgaccgggtccgggccctgctggccaaggcggaggcgaccgacttcccggccgaggccgagtcgtacagcgcgaaggcccaggagctgatcacccggtaccggatcgaggaggtcaccgcccccgcggtcgacgtggtgccgttcgcccgccggatcggcgtcgaccacccgtacgagaacgagaaggccagcctgctcgacgcggtctcgcggaccaacggctgccgcacggtctggtcgccggagctcggattcagcacgatcttcggcttcgacaccgacatcgacggggtcgagctgctctacacctcgctgctggtgcaggcgaaccgggcgatgacccgggacgaaccggccaagggcaaggcccgggtcaaggcgttccgtcgctcgttcctggtcgcctacgccatccggatcggcgaacggctgcgcgaggtcaccgagcagcagttcgccgggcacggcgacctgctgcccgtgctgcgcaaccgggacgtgcaggtccgcgccgcgatggagaaggtcttcccccggacggtccggacccgcggcagccgggtcgacagcctggagggctgggagtccggccgggccgccgccgacgaggcgaagctgcgctgaggccggtccggcaccttgacggcggccggtcagccgccggactcgtccgtctccgcgccctccggcacggtgtcgtcgtcccgggactccagccagccgtacggcagggacaccttgcccggggcgttgacccggccgcggggctgccccagtgactccaccgggaacgggatcgccgggtcgagcctgcccagcaggtcgtccagctcggtgagcgaagagatcatcgcgaggctgcggcgcaggtcaccgccgaccgggaaacccttgagataccacgcgacatgcttgcggaagtcggcgcaaccgtgccgctcatcctccagagcctcgaccagcagctgcgcgtgccgggacatgatcttcgcgacctcgccgagcgtgggcagcaccggctgatagttcgcaccccgggtgaacgcggcctccaggtcggcgaacagccacgggcggcccagacagccccggcccaccaccacgccgtcgacgccggtgtgcgcgaccatccgcagcgcgtccgaaccctcccagatgtcaccgttgcccagcaccggcacgtccagggcctgcttgagcgtggcgatcgcatcccagtcggcctggccggaatagcgctgctcggcggtgcgggcgtgcagggcgaccgcggccaccccggcgtcctgcgcggtcaggccggcctcgacatacgtcaggtggtcctcgtcgatgcccttgcgcatcttgatggtcagcgggatcccgaactcgctcgccgcctcgaccgcctgccgcacgatccgcccgaacagcttgcgccgccacggcagggccgaaccgccgccccgccgggtcaccttcggcaccgggcagccgaaattcagatccacgtgatcggcgagattgcgctcaccgaccatccggaccgccgcggcggtcacatccgggtccacgccgtagagctgcaggctgcgaaaaccctcatcctcggcgaacgcgatcatcttcagcgtcttggggatccgctccaccagcgcccgcgtcgtgatcatctcgcagacgtagacgccgccaccctgctcgcggcacagccgccggaacgccacgttggtgatccccgccatcggagcgagcacgacaggcggattgacggcgtgattgccgagcatgagcggtgcggtcacgcgctctagagtgacacgcccaccccgccccctccgaatcgattccccacgatggccgcagccggaggatccgaccggtccggcacccgcgctcgatccatcacacggccgggcgtccgcacccggccgtcggggaccgcccgccggcgagcctcttgagcgtccagaaaccgcacgcggctgcaggaggcggcccgggtcggacagcacgcgctacgcaggacaacctcgacgtgaccgatcgtcgttccgtctggcagagtcgcgggggtgaccgatggcatggggccgcgacggctggtggtcgtcttcgagtcgccggtggcggaggcgctgcagcggttcgcggtcgatctggggtttcattcggtgctggtggagccggatccgacccggctgggcggcacaccccggccgcacggcgaccgggtggtgggtgacctggcggcggccgagccggacgagcacaccgacgtggtgctgagcgatcaccaccggccggagatcgggccgctgctccaggagatcctggccgggccgagccggtggatcgggatcgtcggcaacccgcggcacgagggcccgcacaccgcggccctgcgggatctgggggtgccggaggcggagatcgcccgggtgcaccggccgatcgggctgaacatcggcagccgcaccgggccggagatcgcgctcgcgatcctggccggcctgatcgccgaccgcaacggccgccccggtggcttcagcttctgactcgcgaaggaccggggcggcggcgcgtcacggcaccttgatggtgaaggtgatcggattcttcccctcggtcaggccccacaggcggggactcgtgcccggctggtacgagaggttctccacaccgccgacctcggcctgctggtgcggcgcctgacccgggacggccttgtggatgcagccgctgttcgacgcacctgacgcacagttcccggcgatgtaccagttgacgccgtcgctggcgatgccctgcatccgccagaccggtgaggtgtacgccgcctcggcgtgcaccttgccgtcggcgctcaccaccagcccggatgtcgggctcaacggccaccggaacgcccggccgccggccgcgttcgcgtccaggtactccgccgagacgatcgagtcggggttgccgccgcgccggtcgagactgatcgcgttgaggcacggccggacgccggtggccgaggtgcagccgacgtaggtgccggtcggcgtggactccgggtagtactcgccgatctccgggagcgcgtaccggtgccagcgtgcgctgggcgccttggacccgtcggcgccgaacccggtctcctcctccgagcggtccatcgcccacaggtgcttcaggctgaacacgtgcatccggccgccattggccacgaggagggtgttgccgtaccagacgacaccgtccgcgtgcgcgctcaggacccggaagttgtccaccccgttgctgctgtagggcaccacgagcagcacgtcgcggaacttgagtgcggcggtgttcgtgtagtcgacgaaggtgagccgggcgaacccgttgttcgggccgtgccagctggccagcgcgattttccggccctcccacagcccgtcgggctgggcgtcccaggaaccggagatgccctgcggggtccaggtgaggccccagccgtcgtcccgggggtcccagcagaagccggtggcgccgaggccggcggggatcccggcggtggggtggcacagcccccaagtgggcttgaagtcctgcgggccgtcgagcgccgatcccagctggggcgtcgcggtcaccttgccgctcgcctcgatccggctgaccaggctcccatagcgctggaagctgtccgacgggtcaagcatgaacggcgccgggtcgatgggcgcgaaggccgccgccgcctcggcgcggccgggcccggcacccatcgtcaccgcgccgaccagcatcgcggccaccaccgccagcagccgtcgccttcgtgaaaccttcggcatgagtcaccttccgttcagcggaagtgaccatggtagatgcttaccgacgcaccggcgggacgccacccatgggcggcggcgatgaacgcggccggaccgccccgagcgcggtgcggggcacggccggcgccatgccccgcatccaccggcgtcgaaccgatcagcaacccggcaggcgcttgatcaggtagtcctcgatctggctgagcgagacccgctcctgcttcatggtgtcccggtcgcgcacggtgaccgcgtcgtcggtcagcgtgtcgaagtcgacggtgacgcagaacggggtgccgatctcgtcctggcgacggtaccgccggccgatggcctgcgagtcgtcgaactcgacgatccagcgcttgcgcaggtcggcggcgaggcccttggccttgggcgacagctccgggttgcgggacagcggcagcaccgcgaccttgaccggggccaggcgcgggtcgaagcgcatgacggtgcgcttgtcgacgccgcccttggtgttcggggcctcgtcctcgtcgtatgcctcgagcaggaaggccagcaccgcacgggtgaggccggcggccggctcgatcacgtacggcgtccagcgttcctgcttctcctggtcgaagtaggacaggtcgacgccggagtgcttggagtgcgtggtcaggtcgaagtcggtgcggttggcgatgccctcgagctcggcgaactcggtgccgccgaactggaagcgatactcgatgtcgacggtccgcttcgagtagtgcgagagcttctccctggggtgctcgtagaagcgcaggttgctctccgacaggcccagcccgcggtaccagttccagcgctcctgcagccagtactcgtgccactgctcgtcgtcgccgggggcgacgaagaactccatctccatctgctcgaactcgcgggtccggaagatgaagttgcccggcgtgatctcgttgcggaagctcttgccgacctgcgcgatgccgaacggcggcttcttgcgggccgcggtcgccacgttggcgtagttgacgaagatgccctgggcggtctccgggcgcaggtagtgcaggccctcggtgctctcggtcgggccgaggtaggtcttcatcaggccgttgaacatcttcggctcggtgaaggtgcccttgttgccgcagttggggcagttcagctcggacagcgaggcgggcagcgagccgtgcttggcctcgtacgcctcctcgaggtggtcggcccggaaccgcttgtggcaggactggcactcggtcagcgggtcgacgaaagcgtcgaggtgaccggaggccgcccacacgtccttgctcaggatgacggccgagtccaggccgacgatgtcgtcgcgctgctggaccatggtccgccaccactgccggcggacgttctccttcagctcgacgccgagcggaccgtagtcccaggcggagcgggtccctccgtagatctcgctggaggggaagacgaagccccggcgcttggcaaggctgacaacggaatcgatgcggtcggcaggcatgagtctcctacgccggctgggtgtcggcgggggtatcgggatgacaggggacccgagccacgctactccccgacggagcacacctcgaacgcgcccgtgctgctgttctgcccgagctgagcctcgacgtggtcggtgccgccgtcggcataggtgaggtcgaccggcacctcaccggtgaccagatcaagatcaccgatggagtacgagtcgatccgctcgtcctgcgtgacgcgggcgcgatactcggtgatcgactcccgcgcccgggcctcggggcagagctgcgcatacgccttggtgtagtcgccggccttgaccgcgtccaggtatttaccgaccacgacgtgcgcctgctcggtgaacgcgctggtcatcgcgaggccgaggccgaccaccgcggccagcccgccagcgcagaccagcgccacgatgccaccgccgatgccgaagccgagcccgatccgacgcccgcggccctcgaccggcggcgccgggaacggcgggtgcacgcccgggccgggcggcgggggcggcgcgacgaaggtgggcgtctcgggaagcgccggatacggctgaccgtaggtcatgcggccagcctagtgctcagcgccacgactcggccgcccggtcactggcggtctcggtcaccggctcccccggcccggcggcggccagcgtctcgaacgcggacggctcgtcgagcgagcgcgcgagcagcggggtggcgtgcaccttcacatcgaagttgcccagcgcgcggcggtaggctccgaccgactcccactcggtcaccagggtccaggcggcggtgtcctccagggcgcgggcgagccggccggacaggtatccggggcatccggcgagggccgcgagcgcggcgtgcgcctgctcccggaagtcgtcctgcgtgtccggcgggaccaggaatcggttgagcaccagcatgtgacgagggtacgcacgccgcgagggagccgctgtgacgacgccggaccattttcttcgccggctggcgagggtgaatcccacctcggcgttcttcgccgcgctggccctgctgctggccggcctgttcctgccgggcgtggtgggcgcgctgctgctggcggtgctggcggccgggctggccacgctgaccttcaccacctggccggtccagccgccgatcacccggctcgtccgggtggtgctgctcaccctgctgatcgtcgcggtgctcggcaaggccctctgacccatgcgcttttgacaatcattgtcattatcgaccacagttggtgccatgatgcgccgcctgctcaccccgctgctcctgctggccgtgctggccggctgcggcgcgcgggccgcggcggacggccggatgccgatcgtggccgccttctacccgctgcagttcgtcagcgagcggatcggcggcgacctggtccgggtggtcaacctgaccaagccgggcgccgagccgcacgacgtcgagctgagcccgcgccaggtggcccagatcgtggacgcgaaggtggcggtgcacgtggccggcttccagcccgcggtcgacgaggcgatagaacagaacgcggcgattgcggggtacgacgtgtccgccgccgccgcgcccgaacatcacgacccgcacgtctggctcgacccggtccggctcgccgcgatcgccgaccggctcgccgtccggttcgggcaggccgacccgccgcacgcggccacctacacggcgaacgccgccgccctgcaccggcagctcgacgacctggacgccgagttccgcacccggctggcctcctgtccgcggcgggagctggtgaccagccacaccgcgttccactacctggccgagcggtatcacctgacccagatcgggatcaccggggtggacccggaggccgagccgtcgccacgccggctggccgaggtcgccgccgacgcccgggcgcacggcaccaccacgatcttcttcgagaccctggtcagcccgaaggtcgccgacaccatcgcgcgtgaggtcggtgcgaagaccgcggtgctcgacccgctggaaggcctgatcgacccgtccgcggactacttctcggtgatgcgggccaacctggcctcgctcaccacggcattggggtgcccgtcatgaccggcggcaccgggcggcaccgccgcaacctgaccatcggcgccgcaggcgagggccacgagggcatgacaaggagggcccagtgagtgtgatcgcggttcggcacgtggcggccggttatgacgggcgggagatcctgcgggacgtggacctgagcgtcgcggccggcgacgtggtcgcggtgctcggcgccaacggctccggcaagtccaccctgatccggacgatcctcggcctggtcccggtgcgccgcggggagatcgacctgttcggcaccgcgcagcgccggttccgcgactgggcgcggatcggctacgtgccgcagcgcctcggcgccggcagcggcgtgccggccaccgtcggcgaggtggtcgcctccggccggctggcccggcgcgggctgttccggctgcccggggccgccgaccgggaggcggtgcggcaggcgctgaccgcggtcggcctgctggaccggatcggcgacccggtcagcaccctctccggtgggcagcagcagcgcaccctgatcgcccgggccctggccggccggcccgacctgctggtcctcgacgagccgacggccggggtggacgcggccagccaggaggcgttcgccggggcgctcaccgagttcgccgcgaacggcggcaccatcctgctggtcctgcacgagttgggcccgctgcggccgctgatcggccgggccgtggtggtgcacgagggccggatcgcgcacgagggggtgccgccggagccggccgggcatcacgccgagccgggccacgaccatgtgcacccgcatgccgacgaggcgaaggccggcatctgcgaatgggcgccgacggacgggatgaaggcgtactgaatggacctcttgacctatcccttcatgctgcgcgcgctggccggtgcgctgatcatcggtctggccgcgccggcgctcggcgtctacctggtgcagcgacggctgtcactgatcggtgacgggatcgggcacgtggcgctgaccggggtcggcgtcggcctgctcacccaccggtcgccggtgctgaccgcggtgctggtctcggtgatcggcgcggtcgccgtggagctggtccgcgaacgcggccgcacctccggtgacctggcgctggccctgctgttctacggcgggatcgcgggcggcgtggtgctggtcgggctctccgacgacgccagcaacgccagcctgatgcagtacctgttcgggtcgctgatcaccacctcgccgcaggacatcgtggtgatcgccggcctgggtgcggcggtgctgatcgccatgctggtgttccggccggcgctgttcgcgctctgcaacgacgaggagtatgcccgggtcagtggactgccggtgcgtacgctcaacctgctcctcgcggtgacgaccgcggtgaccgtcacgatcgccatgcgcaccgtcggtctgctcctggtctccgccctgatggtggtgccggtggcggccgcgcagcagctgacccgcgggttccggtccacgatggcggtggccatgctgatcggggtcggcgcggccggcgccggggtggtgctgtccggccagatcgacaccgcgccgggcgccaccacggtgctgctggccctggccgcgttcctggtgaccgccgcggccggcgcgctgtggcaccgccggcgacgcccggcgcctgcccacgccgaaccgccggacgtggtgctgcatggctgagcagggcgccggccacgggtcgtacgaggcggccggcgcgctgctgcgggcgctgtccgccccgatccggatcgccatcgtggtgcgcctgggcggtggcgcatgctgcgtgcacgatctggtcgccgagctcggcgccgcacagccgctgatctcgcaacacttgcgggtgttgcgcggcgccggcgtggtgcggggtgtccggcgcggccgggagatcgcatactccctggtggacgaccacgtcgcgcacatcgtcgccgacgccgtgagccacgcaagggagaatcgatggtgagcccggacagtgctcagcgcaacaccaagcagcgcagcgcggtgagcgccgtgctcgccgagaccgagggattccacagtgcgcaggacctgcacgcgatgctgcgcgaccggggtgaacgggtcgggctgaccacggtgtaccggacgctgcagggcctggccgacgccggcgaggtggacgtgatgcgcccgcccggcggcgagcacctgtaccgccgctgcagccaggggcatcaccaccacctggtgtgccgatcctgcgggcggaccgtcgaggtgctcggcccggcggtcgagtcgtgggccgagaagatggccggcgagcacgggttcgtcgacgtgtcacacaccatggagatcttcgggacctgcccggagtgcgcgcaccggggctgagtgcgaccctccacaggtgaagctctacgccgaccgcatgcccatcgccgtccgccagctcgtcaccgacatcctcgtggtgatctgggtctacctctggatccgggccgctctctgggttcacgacctggtgcagcaactggccgtccccggccagaagctggagagcgccggcggcggcatcgccgacaacctggccgacgcgggcggcaaggtgggccgggtgccgatcgtcggcgatcagctgaccaaaccgttcgccggggccgcgaacgccgcccggtcgatcgccgaggccggccagcagcagcaggacctggtcggcaagctggcgctgatcctgccgctgatggcggtcgcggtgccgctggccgtgatcctgttcctctggctgccgaggcggctgcgctgggtccggcgggccaccacggcgagcgcggtccgcgacctgccggccgggcgggacctgctggcgctgcgagcgctcgcctcccggccgctgagcgagctggcccggctcggcccggacatcgcgcagagctggcgggccggggacgcggcggccgtcgacgcgctcgccgacctggaactcaggcgcctcggtctgcgtcgagcaggccgctcgtagccgagtcggccggggcgtcgtcgaggacgaagccgtccttgtcgtcgtcggtggcccagcgcttgtgggtgaccggcaggatcgcccagaaggtgaggaaccagccggcgctgagcaccgtcagcaccaccgcccagcgggcgtgcagcacgtagtcggtgaccagcagcacgctgctgaccatcgagaccagcatgcaggccaggccggcgctggccatccggtgcgcataccggaccagctccggtttgcggccctggcggaacagcgcccggtggaacgcgaccggcgagatgatcagcgcggtggcgaacgccgcactgatcaacgccaccacgtaggtgtcccgctggaactcggtcgccttcgggaagccgctggagaacggcagggtcagcaggaacgcgaacaggatctgcacgccggtctgcgccacccgcagctcctgcagcaggtcggcgaaattccggtcccaccgctgcttctgcgtttccttcgacggagtggcggccatggtgagcgaggattcccggtcgcgcccatggtcaaacgccgatgcgtgccaggatcgcgtcgccgagttcgcggggcgcctgttcgggcacccagtggctgaccccgcgcatcgcgaccaactggtagtcggccggcacccagtcggcggtgcgcagcgcggcggtcaggccgaccaccccgtcccggtcgctccagacgtacgtggtcggaacggtgatctcgccgaggtcggcgacgtccgaggagcggaaggcgcggtaccagtggagcgcggtggtcagccggcccggctcgcgcatcgccttgacgtacaggtcggcacgcggcccgatcgcgcccagcatccggcgcatcaccagggcgccgccgccgagcagcagcttctccgccacggcgctgcggaagacctggaagtaggcgagccgggcctgctgggacggccggacccgcagggccagcagcagcgcccgggggtgcggcacggagatcgcggtcagggtgcgcacccggtccgggtgccggccggcgaccagccagccgacctgggcgccccaatcgtggccgaccaggtgcaccgactccaggccgagcgcgtccaggacgccgaggacgtcggcgaccggctcgccgatccggtaggcggggacgccggacgggcgggcgccgggcgagtagccgcgctggtccatcgcgtacgtccgcaggccggcctcgtgcaggcggggcagcagagggtcgaactcccggtgatcctgcggaaagccgtgcagcagcagaaccggccgaccgtcctcgggaccgcccacggccacctcgaacgtcagcccccgggccttgacctccatgtgatcactccctcgctgtgctacatcgccgacctggtgttagcgtcatcgaagcacatgcaccgaagcttttccgcgacggcggagaccagtgcgtccacttcagcgacgcgcgggtcgaggcagccgcgaaagagcttcgtccgacaggggagcgcacagcgctgagagtgcggatcatccgcagaccctcgtacctgatctgggtaatgccagcgcaggaagttcggtctttcttcagccgcgtcaggccgccaggctcggcgtgcgtctcctcccggtaaccgctgggaggcgtatcaatgacatccacccatcgctggcgcacgatagacatcgtgatcgcctcggtgatcgccgtcgcgttcggcgtcatcttctgggcctgggacgcgctctgggccgccaccgagaacgcgttcacgttcttcccgccggcccaggccgtcctctacggcatgtggttcctgccggccgtgctgagcgcgctgatcatccgcaagccgggcgccgcgttcttcaccgagacggtcgcctcgatcatctcggcgctgctcggcaataagtggggcgccaccgtgatcatccagggtgcggcccagggcctcggcgccgagctggccttcgccctgttccgctaccgggtcttcaccctgcccgccgggctgctctccggcgccctggccggcctggtcgccgcggtcttcgactggtacgtctggacctacgactacgacctgtggagctaccggatcccgtacgcgctgatcaccgtcgtcagcgccaccgtgatcgccggcgccggcgcctggctgctggtccgcgcgctcgcgccgaccggcgtcctggaccggttcgcggccggccgccagcgggcattgatctaatcgcggtgagcgaggttcagctccgcgggttcggctggcggcacgcgggccgccgggcctgggcggtgcgcggcctcgacctgcacatccggcacggcgagcgggtgctgctgctgggcccttcgggggccggcaagagcaccctgctcgccgcgctggccggcctgctgcccgaggattccggggaggccgcgggcggcatcgagatcgacgggctggaaccgcccaaggcccgcgaccgggtcggcatcctcttccaggacccgcagacccagctggtgatggcccgctccggcgacgacgtggcgttcggcctggagaaccgcggtgtgccggccggcgagatctggccgcgggtcaccgaaaccctggaccgggtcggattccggtatccgctggaccgctccaccgccgcgctctccggcggcgaggcgcaacggctggccctcgccggggtcctcgcgctgcgccccggcctgctgctgctcgacgaaccgaccgccaacctggacccggccggagccgcgctgatccgcgacgcgatcgcccaggcggtcggcccggacaccacgctgatcatcgtcgagcaccgggtcgccgacgcgttgccgctggtggaccgggtcgtggtgatcgaggcgggcggtggggtgcgggccgacggcacgcctgaggcgatcttcgccgcctacggcgacgagctggccgagcagggcgtctgggtgccggggcacgccgtcgagtcgcggatcgccccggtcaccgttccctccgatctggtacgtgcggaacagaccggcgtgccgggacgcctgcccgccgtgaggctgaccgcgggcgccggcgaagtgctcgcggtgaccgggccgaacggcgccggcaaatccaccctcgcgctgctcctcggcgggctgctcgccccgggaaccgggcgggtcagcgcgttcggtgaccggaaaccgccgcaccggtggcgggccagaaccctcacccagcggatcggctcggtcttccagaacccggagcaccagttcgtcaccacccgggtcgccgacgaactgtcactcggaccccggcggctgggccgcggcgccgccgagatccgggccaccgtcgacgagttgctgcaccggctgcggttggagcggctggccgaggcgaacccgtacaccctctccggcggggaggctcggcggctgagcgtggcgaccgcactggccaccgcaccccggctgctggtgctcgacgagccgaccttcgggcaggaccggcggacgtggaccgagttggtgacgttgctgggcgagctgcgcgacgaggggcacggcgtggtggcggtcacgcacgacgaggaattcgtccgtaccatcgccgatcggaccgtcaccatcggcggaccgcgaccgtgaacctcctcctcgagccgatcgccgacccgggcgcgccgctggcgcgccgcaacccggtggccaagctcggcgccgcgctgctgttcgccctgccgatgatcgcgacgctggacccggtgaccccggccgtcgcgctcggcgtcgaactgatcgcactgccgttcttcggggtgcgggcgcgggtgctcgcccggcggatctggccgctgctgctgaccgcgttcagcaccctggtcgcgatggtgctgttcgccgccgaccgcggtggtgagctgctgttctcggtggggcgggtggacgtgaccaccggcgtgttggcgagcgcgaccggtctgatcctgcggatcttcgcggtggccctgcccgggatcgcggtgttcaccaccaccgacccgaccgacctggccgacgcgctggtgcagaacgcgaaagcgccggcccggttcgcgatcggggcgctcgccgcgttccggctgctgccgctgctcgggcaggagtggcggatgctgaccctggcccgacgggcgcgcggagtggaaaccgggaagaacccggtggcgttcgcgtcgacggcgttcgcgttgctggtgggagcgctgcgacgcggcgtgcggctggcggtggcgatggacgcgcgcggattcgactccggggtgccgcggacgtacgcccggacccagcgcttcaccgcggccgacgcggtgctgctggtgacggccgtggtgctgtccgccctgatcctggcagtgagcgtggtctccggagtgttccggccgatcatcggttgaccgcgcgttcgtcacccggtcaccggctcgccggtggacgttgtccgcacctggcgaaggttcctgacatgaaccattcgccggcccatcggcatgcgccgggcggtcgtcccgcgcggaacagcgactcccgcaattgacttgccggccccgccacgacgcgatgatcatggatgggtgagtcagtatttcgaggtcggcgacctggtcctgtggaatccgtcgaacggggtggcgaggctctacgcgcgcaccggtgaggcggtggcaccgctggtggaactgccgaccggcatcggtccgatgatcgcggacgagtatgagatcgacctcgacgtcttcgtggccttcgtggacgcgttgaccggctactacctcggggcccagcatccgattctccgctcgctgatggagggcttcctcgccacgtcgatcgtcatggtccagcgggccgggcgggagctgccggcgctccgcgagcagcagcggccgcactggtggaacgtctcggtgaccacacgcggggtcgccccgaccgccgaccgcgacgagctgctcgacctggtcgccgagcacgcgatgagcatggcccggtagccgcggcccccgccgcaccgggcgacgggccggctcggtgggcgggatggtgggactgtcgtgcaggtcaccgagggggtgttttctagggtggtgccatgactcgtgcccgactgccgcagctgttggccgacgcccgtagcggggtgttgctgttcagcatcacgccgccgaagcgcagcacccccgaggagcggatcaaggagatcgccgaggtcaccctggagcggctcggccggctcgacctggacgggctgatcctctacgacatcgacgacgagtccgaccggaacccggtcgagcggccgttcccgttcctggcgtcgcacgaccccgcgcagtattacgagacgcacctgggcgcctggaagcagccggtgatcatctaccgctgcgtggggaagtacgccgaggaggagctgcgcgactggatgcgcggggtcgatccggagcaggtgctcggtgtcttcgtcggcgcgtcgtcgggcggcaaggcggtccgcaccgggttgcgccgggcgcaggagttgcgggccgaggtccggccggagctgccgctgggtgcggtggtgatcggggaacggccggaggagcaccggcggatgctgaccaagcaggatcggggagcgagcttcttcatctcccaggtcgtctatcacgtcaacgagaccaagaacctgatctccgactacttctacgagtgccgggcccgggacataccgccacggaccatgattttcacgctgtcgctgtgcgggtcgctgaagacgctggagttcctgcgctggctcggcgtcgacgttccccgctggctggagaactcgctgcggcacaccgccgacccgctcgccgagtcgtacaagcactgcctcgacatcgcccgtgacctgcgggacttctgcgagcacctgggcgtcccgtacggcttcaacatcgagagcgtctccatccgcagggaggagatcgaagccaccacccgcctggccgccgacatcgccaccctcctcggccgctgaccccacccggccgcacgaggatcggctggcaggatggaggcatgctggtcgccttctctgtcacgccgatcggggtcggggactccgtcggggatgccgtcgccgaggcggtgcgggtggttcgggcctcggggctgccgaaccggaccgatgccatgttcaccacgatcgagggtgagtgggacgaggtgatggcggtggtcaagcaggcggtggaggcggtggccgcggtcgccccgcgggtgagtctgtcgttgaaggcggatgtgcggcccggggtgaccggggcgctgaccgccaaggtggaccacatcgaacgggtgctgggcgagtcatgaggcgtctggtgatgtgggacgtcgactacacgctgctgcgcggcggcggggtggcggcccgggcgtggaaggccgcgttcaccgaggtgaccggggtggcctggcgggatacgccgatcttcggtgggcgcaccgacctggacatctgcggcggggtcttcgaggcgcacggggtgaccgactgcaccccggaacgcttcttcgcgcggtacgtggagatcgtcgacacggtccggcacgagttcgccgaacagggtgcgctgatgccgggagtgcgggagatcctcgcccacctcgcggaacggcccgatgtggtgcagaccctggtgaccggcaacgtgcccgaggtggcggcggcgaaggtggcggcgttcggcctgtccggttcgttcgacgccgaggtgggcggttacggcacggacgacagtgtgcgggccaccctggtccgccgcagcctggaacgcgcgcgggcgaaatacggcgagccgttccggccggtcgtgatcggcgacaccgtgaacgacgtgacggcggcgctggccaacgacgcggtcgcgatcgcggtcgccaccggcgccaccccggcggccgacctcgccgccgccggcgcccacgtggtcctgcccgacctgaccgacctggaaaccgccgtcaaggcaatgaccgactgaccgccgcggggcggcgagaggtcacgggcggagttcgggcgggaaacctgtccactgcaacgacgccggcagatggctcacgtcgttgaacatgatcactcgcggcttctggcccgggaaatagcggatcagggtcagcccggcgttgcacgagttcaggccccgccagcggtcttccggtgcctccagcgcgtcccgcacgaaccaggccacctggaacgcgtgggtgatcaccaactcgtgcgtctccaccggcgcggccccggtgaagcgggcgatcatgccggccgagttcgccggggtcggaaactggtcgtcgagttcgtcggcggggtgcagcggcacctcgggcggcagatgcgccgcgacgatcgtggcggtctgcaccgcccgggccagcggactgtggtggacggccgtcagcggcacgtcggcgaggcgtttcccgagcagggcggcctgctgctcgccgtcgccggtcagtccggtctcgtcctcgttggcgaaggcgtgccgggcgatccacaggtgcctcatgacgggctgaccgggttgggcagggcgccgccgaagcgccggtcgcgctgggcgtagagctcgcacgcataccagaggtggcggcggtcgaagtcgggccagagcgtgtccaggtagaccatctcggcgtacgccgactgccagagcaggaagttcgacgtgcgctgctcgccggaggggcgcaggaacaggtcgacctcggggacctcggggtggtacaggtatttcgcgatggtcttctcggtgaccttgtcggctctgagtttgccggccgcgacgtcccgggcgatcgccgcggcggcgtcggcgatctccgcctggccgccgtagttgacgcagaactgcagggtgagcgtcttgttgtgccggctcatctcctcggcggtctgcagctcggcgatcacgcttttccacagccggccggaccggccggaccagaccacccggacgccgaggtcgaccagctggtcgcggcggcggcggatgacgtcacggttgaagcccatcaggaagcgcacctcctcgggcgagcgcttccagttctcggtggagaacgcgtaggccgagaggtaggggatgcccagctcgatggcgccctcgatggcgtcgaagagggagtgctcgccctgctcgtggcccttggtgcgggacaggccgcgctccttggcccagcggccgttgccgtccatcacgatcgccacgtgccgggggatcgccgcggacggcagctggggcggccgggcgccggagatgtgcggggtgggcggacgcgggctcacggtttcaactcccgtcggtcgacaagcggcaacgagcgtaacgagcgctccatgtgccattgcaggtgggcggcgaccaggccgctgcactcccggcgcaccgacggcgcggacgcgtcggcgaccggccagtcgccgctggtgagcgcggccatcaggccgatcgtgtcggggctggggtgggcggcaccgggtggccggcagtcggggcagaccgcgccgccggccgggaccgcgaacgcggcgtgccggcccgggtcgccgcagacggcgcactcggtgagcgcgggcgcccagccggcgaaggccatggcgcgcagcaggtaggcgtccaacaccaggctgccggcgtgctcgccggccgcgagcgccttgagcgcgcccagggtgagctggaacaggcgcagcgccggctcccgctcgaccggggtgagccgctcggcggtctcgcagatggcgctggcggcggtgtagcgcggatagtcggcgaggaagctcttgccgaacagcgacagcgcctcgacctggctgaccgagtgcagcgcgctgcccaccccctcgggcgacccggcgagctgcaggtcgatgtgcccgaacggctcgagccgggcgccgaagcgggaggtggtgcggcgcacgccgcgggcgaccgcgcgcagccggccgtgccggcgggtgagcagggtgacgattcggtcgctctcgccgagtttctgcacacgcaggaccaccgcgtcgtcgcggtagaggtggcgtcgatatccagcgggcactccgccattctgcccgctgggtgcgacaaaccctgacccggatctcagggtcgtctccgggacgggactgatggcgtctcgggtgtccccggaaatagcgtcggcacatgacccgcagagttgcccttctcctcgccgccgcctcggtcgccgccctggccggctgcgacggcgtggtgggcgccaagatgaccttcgacgacaccgagaagacgaaggtcaccgacatcgtgctgagcggtggcagcggcgatgtgacggtgaccaccggggcggtcggcgagacgcacatcaagcgcatcgtgcgcggcggcaacggctccggcccgtcgtatcagctctccgggaccaccctgaccctgcccaccgactgtggcttcaactgctcggtgtcgtacgaggtggacgcgccggccggggtggcggtgcacggcagcatgcggtccggcagcacgtcgctgaccggggtcggggccgtcgacctcaagctcacctcgggggacgtggtgatcgatcacgccaccgcgccggtcaaggtcaaggccacctcgggcagcgtgacggtgaccggcgcgcccgcggtgaccctggaggccacctcgggtgacctggcggcccgggagatcgccgggccgatcgacgcccgggtcacctccggcgacgtggatctggagttgtcccggccggcctcggtgaccgccgtggtgaccagcggcgacctgatgctgcgtgtgccggtgggcagttaccagctcaaggagcacgccaccaccggcgacgagcacatcgaggggatcaccgacgatccccggtcgccgaacgtgctggatctacgcgcgcgcagcggcgatctcaccgtcggcaccctctagggccggggccggcgacaccgggaccggcaccggccggccgggcagcagcgccggccggcgtccggcggccacgtcctccacccagccgaccagggccagggccacggcgatgagcagcgtcacgacgatcagccgccagccgatcccgtacgccccgcggaccggcagcccgtgccgttcgccgaactcggtgaccccgagcaggatcgggatgtgccagaggtagatgctcagcgcccgcgcgttgagcacggtcagcacccggtgctcgccgaccctcggcgagcagcccatcgcgaccagcacgaaggccgccgaccagagcgcgttgccgatcgggatgtcgttcaggtcgaggccgcgcggcccggagtgggtgagcacccacgccatcccgggcacggcgagcgcggccgccagcgcgatcagccgcttgcgcgggatccgggccaggtgcccgtcgtgatgggcgaaaccgagcagccacgccccgccgtacagggccaggtcgtgcaccacgttgacgacccgggcgccggtgagctccaggaccagcagaccggcgtacggcagcaggaccgcgatcagcgggatccgccggaagaccggcagggccagcggcgagagcagcacgaaccagaggaagtcccgcagataccaggcgtggctgagcgaggccatccaccagccggtggcctccgggtcgaccagcggaaaaccccagagcagcagatgtacgtcgaacggggtaccgctgatcagcatggccggcaccgcgatcagcagggtcagcacccagagggagggcagcagccggcgcagccgccgctccaccgcccacaccccgaagcggtccagggaggccgccatcagcgacccggccagcgcgaacatcaccgacatcgccgggaagacgatggtcagcgcggcccagccggtgaggtgatagacgaccacccggacggtggcgatcgcgcggagcaggtccaggtaccggttgcgcatggccaacggtgttacccgctttgggaccttaagtgcaaattccggtgaagaatcccataatcaggacatatgcacctttagatgtcagaagcccaacttccggagctgcttcggatcgcgctgccactccttggcgacccgcacgtgcagatcgaggtacaccttcctgcccagaagctgctcgatctcgccgcgcgcccgcgtcccgaccgtcttgagccgctcgccgcgcgtcccgatcacgatcgacttctggctgtcccgttccacgtacagatccgcatagatcttcgtggtcctgccctccacctgcatctcctcgaccagcacggcgatcgagtggggcagctcgtcgcgaaccccctccagcgccgcctcgcggatcagctcggcgatcaggacctgctccggctcgtcggtcagcacgtcgtccgggtacaactgcggggactccggcaggtaacgcaccatcacgtcggtcagcgtctccacctggtgcccggacaccgcgctgaccggcacgatctccgcgaagtcgtacagctcggcgaccgcgagcagccgctgtgccagggtctgcggatcgaccaggtccaccttggtgaccaccgcgatcaccttggccttgagctcgccgacctccgccgagatgaaccggtcaccgcgcccgaccggctcgtccgccgggaaacacaccccgatcacgtcgacctcgctccacgtctcgcggaccaggtcgttgagccgctcgccgagcagcgtgcggggccggtgcagacccggcgtgtcgaccagcaccagctgggcgtccgggcggtgcaggatgccccggatcacgtgccgggtggtctgcggcttgctcgaggtgatcgcgatcttctgccccacgatcgcattggtcagcgtcgacttgcccgcattcggccgcccgacgaaacaggcgaaacccgcccgatacacgccgtcgtccctgcggtccgacgccgccgccttatgccgatgcacccgttgcggcgcgctcggggcacgatcgtccgatggcggtgtacgccgttccgcgcgcccgcccgcaccccgcacccgccccggggcgcccgtcgagccggcgcctagctagctagtggcctctgccctggacctggccctggccgtcggccgccttgcgagccgcccggcgctcctggcgccgcagctcgttgcgctcccccgcggtcagccgccgctcgttctcgtcggccatcaggagaccgtgccgagcagcgtcccggacgggccggccacgtgcaccggcgcgtcggcggccaggtcacgcaccgcggcgtgcccggcgccgtccagcgtcgacgcctcggtcaccaccgccgccgcctcgatcttcgtggcgccggacgccgcggcctgggccaccgccagctgcaacgcggtcagcgacaggctgggcagcgccaccgaggcggccgcgtaggtgcgtccgtcctggtcacgcaccgcggcgccctcggccgcaccggcccgggcgcgcgaactgcgggccagggtgaccagcttggcgtcctcggcgctcagcgcggaaccgtccgccccgggcacagggacggcggcaaagctctgctcaggcatcagcgggaagtctttcctcgttctcggttacgttctcgtcgttgtcatcggtcggcgtgaccggcgggacccggcgcaccagcaccgagtcgatccggttccgccggccggcggtgccctcggcgatcaggtgcaggccgccgacgtcggcctgggcgcccgggatcggcacccggcccagcgtctgcgcgagcaggccgccgaccgtctccacctcgtcggtgggcagctccacgccgaacacgtcgcccagatcctcgatcggcagccgggccgcgacccggaccgcgccgtcgtccagatgctcgatcggcgggcgctccacgtcgtactcgtcggtgatctcgccgacgatctcctccaggatgtcctcgatcgtcaccagaccggccgtgccaccgtactcgtcgaccacgatgaccaggtggttgcgggccgcctgcatctccgacagcaggtcgtcgaccggcttcgactcgggcacgaaggtcgccgcgcgcatcgcgtcggccaccgcctgcgcggccgccgccggatcgccgttctgcgtgcggcggatcacatccttgagatagagcacgcccagcacgtcgtcgacgctctcgccgatcaccgggatccgggagaacccggaccgcaggaacaggtagagcgcctgctgcaacgtcttcggcgcctcgatccacaccatctcggtgcgcggcaccatcacctcacgggcgatcgtgtcgcccagcgcgaacaccgaatggatcatctcgcgctcgccgtgttccaccacgccgcgctgctcggccaggtcgaccagctcgcgcagctccacctggctgccgaacgggccctccgggaaaccgcggcccggggtgaccgcattgccgatcaggatcagcagcgaggcgagcggattcagcacccggcccagccagcggaccagcggcgcggcggcccggcccacggcgtacgcgtgctggcggcccaccgtgcgcggcgcgacacccaccaccacgaagctgaccagggtcatcgccccggccgtgaccagcgccgcggaccagccgatcccccagttgtccaccgccaccagcgccaccagggtggtggccgacagctcgcagagcagccggatcagcagcagcaggttgacgtagcggaccacgtcggaggcgaccgcggtcagcgcgccggccccgcgctgaccctcccgggccagctcggacgaccgggccgcggagaccgtggccagcgccgcgtcggtcatcgaggcgagaccggccagcaggaccagcccgaccgcgatgatgatcagttgcagttcgggcagggtcgaggcggaattcacgtcagccggctttacgaccggcgcgccagctctgcaggagcttgttctgcagggcgaacatctcccgctcctcctccggctcggcgtggtcgtacccgagcaggtgcagcgcgccgtgcacggtgagcagatgcagctcgtcggcggcggtgtgcccggcggcgaccgcctgcttggcggccacctccggggccagcacgatgtcgccgagcagggccggctcaccggcgcccgactcgcccggaccgtggtcgacgctgccctcgtccatcgggaaggccagcacgtcggtcggcccgtcgctgcccatccagcgatggttcagctcggccatgtagtcgatgtcgacgagcaggatggacagctcggcgagcgggttgacccccatctcgtcgagggcatgccgggcaaccgcgaggatcgcgtcggtgtcgacctcgactcccgactcgttggcgatctcgatggacatagtggtgcgattaccccttgcgaatcagcgccgccgcggggcgcggccgttggcggcccgcccgggaacggcatgaacggaattggctgcctgctgctgctcctgctcggcgtcgaaccgcgcataggcgtccacgatctccgcgaccagccggtgccgcaccacatccgagctggacagctcggcgaagtgcacgtcctcgacgttccgcaggatctcccggacgaccttgaggccgctggtcgtgccacccggcaggtcgacctgggtgacatcaccggtcaccacgatcttggccccgaacccgagccgcgtcaggaacatcttcatctgctcgggcgtcgtgttctgcgcctcgtccaggatgatgaacgcgtcgttgagggtgcggccccgcatgtaggccagcggggcgacctcgatggtgccggcggccatcagccgcgggatcgactccgggtccagcatgtcgtgcagggcgtcgtagagcgggcgcagataggggtcgatcttctcggtgagcgtgccgggcaggaagcccagccgctcgccggcctcgaccgccggccgggtcaggatgatccggctgatctgcttggcctgcagcgcctgcacggccttggccatcgccagatacgtcttaccggtaccggcggggccgatgccgaagacgatcgtgttctcgtcgatggcgtcgacgtagtgtttctgtcccagcgtcttgggccggatggtgcggccccgccgggacaggatgttcagcgtgagcacctcggcgggtcgctcggaggtggtgtcctcgaggatccgcagggtgcggcggacggcgtcgacgctgagcgtctcacccttctcgatgagctcgatgagctcggagaagagtcgctcggcggtggcgttgtccgccggctcgccggtgatggtgatctcgtttccgcggacgtgcacatcgctgctgagcgtgcgctcgatcaggcggaggatctcgtccttggcgccgagcaggttcaccatgatcttcgggtcggacaccgagatcttggtctgcgcccgcaccgggctggacgagcccgtgctggaagggttcggcgtaccggtcatagggcggcccgggggcctccgccacctgctctcattctcggcgtcacccctgtgcggagcggcgtgctcaaggatcgtgccatcctatccgctcgcacgccgccccgccgatgccattatcgcgccaccgccgccgaggcgacgcggatcacccgtccgacgccggccgcgcgcagccctcgcggacgtggatcacccgtcggatgccaggccgccgtcgaaggtctgctggtcgcgggtgaaccggtaggtggcccagtgcatccggaccaccgcgccggagtcgtcccgggtcaaccggagcagctcgccggcctcccgcccggagaccgtgcgcaacacgtccggccgatccggcagcggctggaagatcgccggcggccggtccgcgggcgcctcggcgagccgggcctgcagccgcccgtcgtgccacccgaagacgaagtcggagccctcgctccaccagcggcccaggatcgagcggtacgcggcgggcgccggcgcggccatccgccagggccggatctccgccggatcggtctcgaccgcgagccgcagcagctcgtgggccagatcgatggtctgcccggcggtgcccgaggagccgagcaccgcgcagccgaggccacccgggttgccctcgccgccgcgccggccgtagacgccggccaggaagccgggcatcgccccgtcgtgaccgacatgtgtcacccgccggccctctggggcgaggatcaggccgagcccgaagccctgcgcccagagcgcctcgtcggtggtggtgaccggccagcgcatctcctcgacggtggccgccgcgagcacccggtcgtcgtgcgggtcggccaggaaggcggcccaccgcgccatgtcggtggcggtgctccagagctgggcggccggggcgaccccgcccaggtcgatggccggctccgggcgggccgcgtcggagtacgcgtcgaccaggtagccgacgaccgcctcggccggccggtcgacggtggtgcgggtcaggccgagcggggccaggacgcgctcggcgaggatctccgcccaggtgccgccgcgcagcttggcgacgagctggccgagcacggcgaggccgaggttggagtagtggtagcggcgggcgttgggcagcacccgctcgacccggtccagttcggcgagcatccgggcggcgtccgggctgatcagggtgtcccacacgtcgccgtgcggctcacgctggtatccggcggtgtgcgagagcagccggcggatggtggcgtcgccgtgcgccgggacgtcgaggtagcggctgaccggctggtccaggtcgagcaggccgtcgtcgcgggcctgcatgaccagcaccgcggtgaacgtcttggtgaccgagccgatccggaaccggctgtccgggccgagcggccggcccggtgtcccggactcgccgacggtgcacacccaggggtcgcggtcggcacggaccagggcgacgctgagcgccgggatccgtccgtcggcctgcgcccggcggaccgcccgctcgtaccgcgggtggtggccggtcaccgggcggccagcatgcggcccagcggcgcgcccccgacgacgtgcgcgtgcacgtggaagacctcctggccgccgtgcgcgccggtgttgaagatcactcggtagccgtcggtggtcaggccctcggcggcggcgaccgcggcggccgtggccagcacgtcggcggccgcggccgggtcccggaccgccaggtccgcgacgtcggtgtagtggccgaccgggatcaccagcacgtgggtcggcgcctgcgggttgatgtcccggaaggcgaccgtggtctcggtgcggtgcacgacggtcgcggggatctcgccggcgacgatgcggcagaacaggcaggagttgtccacccgtcggatcttatgcggccaccaggtcggcttgaatgggtcccggaataccccacccctgcccgggagcgctctcacatgaccgacgttgatcacctgctcgaccggctgaccctggacgagaaggtgtccctgctgaccggacaggacttctggtcactgcccgcgatgccgcgcatcggcctgcgctcggtggtgatgtccgacggtccggtcggcgtccggggcaccggctgggcgccggagaacccgtcgatcgccctgcccagccccaccgcgctggccgcctcctgggatccggagctggccgtcgaggccggccggctgctcggtcaggaggcccgcgccaagggggtgcacgtggtgctcggcccgaccgtcaacctgcaccgtaccccgctgggcggccggcacttcgagtgctactcggaggatccgctgctcaccggcgagatcgcggccggattcgtgcgcggggtgcaggagcacggcgtcggcaccacggtgaagcatctggtcggcaacgacttcgagaccgagcggatgaccgtcgacgtgcggatcccggaacgggcgctgcgcgagctgtacctggccccgttcgagcgggtggtcgaggccggcgggtggggcgtgatgagcgcgtacaacggggtcaacggcgcgtcgatggcgcagaacggccggctgcaggacgaggtcctcaaacgcgagtggggtttcgacggggtggtcgtctccgactggcgggccgcccgggacacggtcggcgccgcgctcggcggcctcgacatcgccatgccggcgatggacaacccctgggggccgcggctcgcggcggcggtccggtccgggcaggtgccggtcgaggtcgtcgatgacaaggtacgtcgtctcctccggctcgccgcgcgcgtcggcgccctgggtgcgccaccggtggtgacggccgcggcggtggacggcggcgaggtggcccaccgggtggccgcccgctccttcgtgctgacccgcaaccggggcgtgctgccgctgcccccggagcggaccggcgggatcgcggtgatcggcgcgctcgcccaggacgcccgggtgctcggcggcggcagcgcccaggtcgccccgccgcacgtgatctcgccgctggacgggatccgccgggtgttcggcgacgtcgcctacgcggtcggcgccgacccgcgcccgttcctgccggccgcgcagggccccggctggtcggcgttcaccatcgacctgggggcgtaccgcttcgaggtgcccaccgccgcggtccgctggctcggcgacccacccggcgggctcgccgtgccggacgtcacgacgctcgaactgaccaccacgtacaccccggaaatcggcggtgagcacgtcttcgcggtctccggcttcggcacgttccagctgaccgtcggcggtcaggagctctaccggggatcgctgcacccgcccggcaccggccgcgccgacctgctcctgcacccgcgcgaacagcgctttccggtgcgcctagccgccggcgaaccggtccggctgaccctgcggcaaagcttcgcaccagggacggcgcactcggccggcaccaccctcgggcaccgcccgcccggcccggacgcggacggcctgatcgccgaagcggtcgatctggcccgccactgcgacgtggcggtcgtcgtggtcggcaccaccgagcaggtcgaatcggaaggcttcgaccgcacctcgctggccctgcccggccggcaggacgaactggtcgcccgggtcgcggcggccaacccgtccacggtcgtggtggtcaacgccggcgcgccggtgctgctgccctgggccgacgaggtggccgcggtgctgctcacctggttccccgggcaggaggcgggcgccgcgctcgcggcggtgctgagcggcgccgaggaacccggcgggcgactgccgaccacctggccgcggcacgagacggactgcccggtgctgacggtgcagccccgggacggggtggtgacgtacgacgaagggatcttcatcggctatcgcgggtggcgggccgcaccgttgtacgccttcggatccgggtccggatacacgacctgggagtactccgggctgacggcgaccgcgaccgaggtggcggtgacagtgaccaacagcgggcagcgggccgggcgggaggtcgtgcagatctacctgtccgcgcgggacgacggggcggtcgaacggccggagcggtggctggccgggttcgcgtcggtcacggccgacgccggggagcgggtcacggtgcggattccgctgccggagcgggccttccaggtctggacggacgggtggcggacgctgcccgggcgttacacggtcatcgcggcgcacgctctggacgatccccggctgaccgccgagatcgagaaaccgcaggcttgaccgcctccgtcccgaccggcccgccgccttcggccgccgcggcggggtggtcgcggaggttcgcggaggccaggaccaggagcagctggaacacggcggccagggccatcgcgagccagacgccgggcagaccgagccgggccgggagccacagggcgagcagcgtctgaagggcggtgccggcgacggtgacggcgaacaggcgggcgccgcggccggccgccatcaggaagccggccaggccgatcaccgcggcgatcggcaccaggtagccgccgacgcagcgcaggaacagcaccccggcggcggccaccgcccggtccgcggtgaacagccgcatgatcagcggagcgaacccggcgaacagcgcactcgccccgatgccggcgaccagggccagcgtgagcacctgccgcccgatggcggcgcgttgcccgggccgggcgctcagggtgcgcggcgtgtggatcgtcgccgcgttccggatcgcgtagaaacccatggtcgcgaaatacaggaccttcaggccgatgccgtacgccgcgacggccgcgacgccgtgccggcccaccaccgcgagcagcaccagcgccccggccatccgcaccaggaaatccccggcgatcggcgccccggtccgcgccaccgcccggaccggcagggcggcatccgggcgcagccggccgccgggacgtccccggtggagccggaccaggcccccggtcagggccaccgcccgcccggccgcggtggccagcgcggcgccggtgacccccaggcccgcgccgtagatcagcagcggatccagcaccaggatcagcgcgttcgcggtcagcgcgaggcgcatcggggtgcgggtgtcaccgcgccccgcgaagatcgcgtcgaccacctgctgggcgtagaagatcgccaccccggggaacaggacggccaggtaggccccggccagccgggccgcgcccggatcggcgaggaaggcgccggcgagcgtgccgcgcagagccgtcccggccagcaccacgaccggtgtgatcaccaggtagagccgccacccggcgcggatcaccgcgagcgccccggcctcgccgccggcagtcgcgccgccggcagtcgcgccgccggggcggtcgcggccggtgtgcgtgtcaccggcgcccagggcggcggcgaggcggaccgtgactccgccgctgatcagcaggacgatcccgagcagcgcgttctccacgccggtggcgacggcgaccgctgcgaccggggacgggccgagccgggccacccaggcgacgtccacgatcccggtgaggacgccggagagcagggccacatagttcggcacggccagacgcaacagcggggtgcggtggttcatcggtacctcgtttcgttctacctcgaatcgaggtaccacggaacgatataggctggcccggcaccgaacaaccgggaagggcagtgatgctggcgctcgcgatcctcggcttcctgcacgacgagcccctgcacggctacgagctcaaggaccggatcaggtccctcaccggtcacgtccgcgcggtcagcgacggcgcgctctacccggcgatcaaccgcttgaccgccgccggcctgctggaacgccgtaccgagccgggcacgtcagcagccccgcgccagatgttgtcgctgaccggggccggccgcgccgagctgctgtcccggctgcggtccccgtccgaggtcgagatcaccgaccggaaccgctacttcacgatcctcgcgttcctgcgccatctgccggatccggccgatcaggccgaggtcctgcgtcgccgcctggcgttcctggcggcccccgccacgttcttctcccagggcggcacccgcctgcgcgccgccgatgtcagcgacccgttccgccgggggatgttcgagatagcccgagccacctcgcaagccgaacgcgcctggctcgaacgcaccctcgccaccctgacgccctgactccacaccaccgcgccgcccccaccaccgcgccgccccacgcagcggcagcggcagcggcagcggcagtctagctagctagggcgaactaccagcggcccagccgggtggcgaggacggcgagggcggcgacgcccgcggtcgaggtgcgcaggacggtgctgccgaggcggaccggaagtgccccggcgtcccggaatgcggtcacctcggcgtcgctgatcccaccttccgggccgaccaccagcacgatgtcccccgcatcgggcaggccgacggtgctgagccgctcggtggcttcctcgtgcagcacgaacgccgcggacgcctccccgatgcgggcgccgatctgcttcgtcgagcagtccgggtccccacccaccagcggcagccaggagcgccgggcctgcttggccgcttcccgggcggtcgacgcccacttgtcccgggccctgtgcccccgatcgccgcgccactgcgcgaccgaccgggacgccgcccacggcaggatctcgtcgacgccgacctcggtcatcgcctgcacggccagttcgccgcgatcccccttggcgatgccctgcgccacggtcagccgcggcgccgcggccggctcctgcccccgctcccccacggcgacgtcgacactgcccttgcccacggcgaccacctcggcgaacgccgtcccaccccgcccgtcggcgagaatcagcgtctccccggcccggagccgctgcacggtcgcggcatgatgcccctccgccccgtccagcgtgaagaacgacccggacggcaggttctcgaccagaaacagcggcgcagacaccccccgaacgctaccgcccgccccgccccgcaccacccgccgggcagtcgactcggctttgcgatccgaccgcggccgacagcggatgtggaagggtgcggcgattgctcgggacgcgcagcggccacatcgcccgactcgctcggccccgatgagcagcgatcagttgtcggccggagcgtacgacatcaagaccttggtcttggcgagcgggaacgcccagaaagcagaaagcgcgagcggtgatcaaccgaccaccacccgcgcccctggacgatccgaccctaatggccgttgaaggcatccctcatccggctgaagaagcccccctgcttgctcagctcggcgatgtcctcgccgcgcgtcttggcgaagtcgcgcagcatccgctcctggtcggcggtcagcttggtcggcgtcttgacgtccagatggacgaagaggtcgccccgcccctggccgcgcagatgtggcacgcccttgccgcggatccgcagcgtgctggccggctgggtgcccgctttgacctcgatgttctcttcgccgtcgagggtcttgatggtcatccgggtgccgagcgccgcggcggtcatcgggagggtgacgcggcagtgcaggtcgtcgcccttgcgggagtagacgtcgtgcggccgctcgtggatctcgacgtagaggtcgccggccgtgccaccgccggggccgacctcgccctgctgggccaggcggatccgcatgccgtcctcgacaccggccgggatcttgacggtgagcgagcggcgggtgcggatgcggccgtcgcccgcgcaggtcgggcacggggtcgggatgaccgtgccgtgaccggagcagttctggcaggggcgggacgagacgacctggccgaggaaggtgcgctggaccgactggacctcaccgcggccgccgcacacctcgcaggtggccaggtgggtgccgggggcggtgccggcgccggagcactgggtgcagagcaccgcggtgtcgacggtgatcggggcctcgacgccgaaggcggtctcgaccaggtcgagttcgaggcggaggatcgcgtcggcgccgggacgggtccgcgggcgcgggccgcggctgccgccgccggccgcggtgccgaagaacgcgtccatgatgtcctggaagccgacgaacgggccggcgccgccgggtccgccgccgggcatgccgccgccgggtgcgagcgggtcaccgccgagatcgacgatctgccgcttctggtcgtcggacaggacctcgtaggccgcgttgatgtccttgaacttctcgtgtgcctccggatcggggttgacgtccggatggtattgccgagccagtttgcggtaggcgcgcttgatctcgtcgtcggtggcttcccggctcacgccgagaattccgtagtagtccttggccacggggtttggagtcctcaatgtctgcgcggatccgtcaattctgtgccaacaggtcgccaacgtagcgtgccactgcacgaacagtagcgatggtgccggggtagtccatccgggtcggccccagcacgccgagcccaccaacgatcgtggcacccggtccgtaaccggtgctgaccacggacgccgaccggaggttgtcgatctcgttctcgtcgccgatccggacccgggtggtgctgggctccagatccccgatcagcttgagcaggatgacctcctcctccagcgcttcgagaacggggcgcagcgtgccctgaaagtccagcacaccgccgcgggtcaggttggccgtcccggcgagtgcgaggcgctcctcactccggtcgaccagagtctccagcagcacggtggccaggcaggccatgtcaccgcggcgctccggagcgcactcctcgacgagtttctgcaccaggggcggggtgtcggcgaggcgctgaccggcgagtttctcgttgacccggcggcgcaggtcccacacgtcgccttccggaaccggggcgggcatctcgacgaggcgctgctcgacccggccggtgtcggtgatcatgacgagcatcagccgggtggtggagatcggcaccagctccaggtgccgcaccgaggagcgggacaggctcggatactgcacgaccgcgacctggcgggtcagcgtggcgagcagccggacggtgcggtgcaccacatcgtcgaggtcgacggcaccgaccatgaagcgctcgatcgcgcggcgctcggccgggctgagcggcttgatccgggtgaggcggtcgacgaacagccggtagccggcgtcggtggggacccggccggcactggtgtgcggctgccggatgtagccctcctcctccagcacggccatgtcgttgcgcaccgtggccgacgagacgcccagctgatgccgctcgaccagcgctttgctgccgaccggctcgcgagtcttgacgtagtcctcgacgattgcccgcaacacctcgagcttgcggtcatccagactcatatgacccctccccctctggcactcccgcggacagagtgccagtctacgtcgccgctggctgcagcgcgatgatcgaaaggacggaccgcttccggtatttacggcggcggacctaccgtgacagtcatggcggaaccgaaacagtacggccgacagccgcgacccggctacagcctggagcggaactgggtgatgacggcacacgtcggcggtgccgcgggtgccctcctgggcggcgtggcgggctgggtggcgccgctgctcgccctgctcaaccagggtggccggagtccgacggtgcgggccgcggcggtccaggcgctgaacttccagatcctctggacgatcgtcgcgctggtcggctgggcgacccggtggctcgcggtgggcaccgtcatcgtgccggtcgcggcggccgtggcggtcatcttcggcctgatcgccggcacccgggccctgggtggcgagccgtacgactacccggccaccgcgcggttcatcagggaatgacgtcccggatcaccgcatcggccagcagccgcccgttcagggtgagcaccaaccggcccgcggcgtaggcctccggatcgagcaggccgtcgtccagcgcctgtttcgcggccttcgcgtcgaccttcgccagcgtgatgccctcccgcaggcggacgcgcagcatcacatcctcgacgtgccgatcctcggcggtcagcacctcgcggccgtgccccggggaaagaccctcctgcaaacgcccggcgtacgccgacgggtgcttgacgttccaccagcggaccccgccgacgtggctgtgcgcccccggccccagcccccaccagtcggccccggtccagtacagctcgttgtgccggcagttgccgcccgggcgcgcccagttggacacctcgtaccacccgaagccggcggcggtgagcgcctgctcggcggccaggtagcggtcggcggccacgtcgtccgaggggtagggcagctcgccgcggcgcatccgcccggccatccgggtgccgtcctcgacgatcagggcgtacgcgctgacgtggtccaccccggcgtcgatcacggtgcgcagcgagcggtcgaagtcctccggcgtctcccccggggtcccgtagatcaggtccaggttgacgtgctcgaacccggcgcggcgggcctcctcggcggcggccggggcgcggcccgcggtgtgccggcggtcgaggacccgcagcacgtgctcggccgacgactgcatgcccagcgagatccgggtgaagccggccgcccgcagcgcccgcagcccggccgggtccaccgactcggggttcgcctcggtggtcacctcggcaccggccgccagcccccacgtccggtcgacgccttccaggatccggcccaggtccgccggactgagcagggtcggggtcccgccgccgacgaacaccgtgtcgacccgggccggccggatcacccgggcggccagctccagctcgcgcagcacggtgccggcgtactcgtcgcggctggctccgccgcccagctcgctggcggtgtacgtgttgaagtcgcagtatccgcaccggctggcacagaacggcacgtggacgtagacggcgaaaccccgtccgcccacgtcgcgcgtggcgtcgtcggggagcgacccgtcgtcgggtacgggttcgccatcggggagtgcgccggccatgcggcaagtctgccttagggtgccgggatggaattggtccgtaccgtcaccgacgccggggtgaccaccctcaccctggacagtcccgccaaccgcaacgcgctgtcccgcgccctgatcacccagctgctggccgcgctcggcgccgcggccgccgcgccgggcacccgggtggtggtgctctcgcacaccggcccggtcttctgctccggcgccgacctcaaggagaccgccgccacccggcccggtgaacgtctgccggtcgagctgatggccgacctgctggccgcgctctgggagttccccaagccggtggtcgcccggatcgccggaccggcccgggccggcgggctgggcctgatcggcgcggccgacatcgcggtctgcgcggaatcggccacgttcgccttcaccgaggtgcgactcggggtgatcccggcggtgatcagcgccaccgtgctgccccggctgtcggcccgggcggcggctgagctctatctcaccggtgacgtcttcgacgggcgccgggccgccgagatcggcctggtcagcgcggcggttccggccgaggcgctggacgacgcggtggccggctactgcgcctcgctgatccgcggcgggccgctcgccctggccggcaccaaacagctgctgcgccgggcgcggtcggagtccatccgggccgaactggctgatctcagtgaccgttcggccggatacttcacctctccggagggccgcgagggggtcgccgcacgtcaggaacgacgggagccgaactgggtcccgacacagcaggaatgatcttcgagcgcgcgttgactaggctgggcgtccgacagcgaggaggtgtgggtgaaagcggtcatcggagtggtcggcgcactcgtcctcatcgccgtggtcagcgtggtcatcgtcctgcaccaggcgcccggggtgatcaaactgccgcgactcgggccggagtgcacggtcagcgccgacggtgaggtcactctcgactcggtgcagatggccaacgcggccaccatcgccgcggtcggcgtccgcaagcagatgcccgagcaggcggtggtggtcgccctcgccaccgccctgcaggagtccaagctggaaaatctcgacgagggcgaccgcgactcggtcggcctgttccagcagcggcccagccagggctggggcaccatcgagcagatcaaggatccccggtacgcggccggcaggttctacaccgccctgaagaaggtgaagggctacgagcagatgcgggtcaccgacgcggcgcagaaggtgcagcgctcggcctacccgaacgcgtacgagaagtgggccgacgagtcccgggtgctgacccgcgcgctgctcggccgggccaccggcgcggtggcctgcacggtgcccggcaccccggtgctgcgcggcgcggccgcggcggccgccctgatggccggcctcaaactcgactggggccggacgctggacgccgccagcgaggaggcagccggcctgaccctgtcggtcagcaacccgaaatccggctggcgatacgcgcactggctggtctcgcacgcctccgcgaccggactcgaacgggtacgtttcggtgacctggagtggcacgccccggacggaaagtggcagcaagtaaccacggccgcggcccgtgacgacggccgggtcgtcgccgaagtcttcaactgacaccacgctccgcaactttcggtgaccgctcgtgtgcgtggaggctccgacctggattgcgctgcgtatacatcgacatggacagtccgcaaccacccctggtactaagtagggcgtgttctggggagcgctcgaatggatcctgctcggagcgggtggcgtcggcgcgatcatccacggggtgcgccgtcatcgaccggcgcggaaggccccctggtggctgctcgccggctcggtcgccgtgctcgcggcgggtgatgtctgttactcgtatcgacagatgggcacggccgacatcttctacctggtgatgttcggcctgaccgccctctgcctgctgcagttcacccgcggcggcgcgctgctcggcgaccgggcccggctgatcgacctgctcgcgctggcctgctcgaccctgctggtggcctgggtcttcatgatcggcgtggacggccggctggacaccgtctcggcccccgacgtgatcggcgacctgctgctgaccggggtcgccggccggctggtcggcgccgaccggcgcaacgccgcggcctggctgctgctcgccggcgcggccgggatgctcgccggcgacatcggctatccgctggcccgcggcccgctcaccgagtcggcgtacgtggtgctctacctctgctggggcctggccgcgctgcacccgtcgatggtccggctgaccgagccggccccgccccggcacagcccgtggcgattccggtggtcggtgctgctcaccctgtccgcctgcaccccgccggccgtgctgctgatcgaggcgctgcacggggaggtgaaggacggcctggtgatcgcgatcaccggggcgctcaccctgctgctcacgatcacccgactggccgactcgatccggcagaacagccaggcgctcagccgggaacacgcgctgcgcaccgcgaccgcggccctggtcgcggccgccgaccggccggccgtcgacgccgcggtgcgggccgcggtgatccagctgctgcccccggccgcgatacgccgggtctcgctcgccgacgaactcggccccaccgagctgccgatcggcggcgccgaaccggccaccggcccatccggccgcgccgaaccgaccgccggccccgcggaccgcggctggtggctgccggccgccgaccccgacgaccggaccctggtctgcccgctgcggctggaacctctcgacgtggcccggcccagcggcggcgcgctggtcctcaccggccggcgggaggacctcatcgccggccgcgacgcgctggaagtgctggccgggcaggccgcgctggccctggaccggatcaccctggtcgaggcggtcggccgccgggacagtgacctctacctgcgcgcggtgatccgcaacaccgccgacctgatggcggtgatcgacgccgaccagcggatccggtacgcgagcccggcgctgcgccacctgctcgggcaggacgagctgcccccgctggccaccctggacgagctgatccacccgtgcgaccgggcccgggtgcgcggcgagctgcggtcgcagggcgacggcacgatccactgcgcgttgcagcgcgacgaccagagtcaggtgctggtcgagctgacctaccgggatctgcgcgacgaccggctggtccaggggctggtgctgaccctgcgggacatcaccggcaatcacgacccggtcgaacgccatccgtacgccgagcccgggggcgacctcccggcctgggtcaatcgccgatccgcacggcaacgtttccgttattgaaagccgattcaggcgtacgccgcaatccgcttctgatcgcagagaaacgccgcgccccgagcggggtgcggcgtttctcagttgatgcgcggccgatgttatcgggtcaggccacggcgaccggtgatacccacggtgagggcgacaccgaccgcggccagcacgacctggaagaagaactcgatccagtcgaagcccttggtgtcggcgacaccgaaggcccgggccagcacggtgcccagcagcgccgcgaccacaccgatgaccatggtcagccagatcgggatgttctgcttgccgggtacgaccaggcgacccagagcaccgatgatcagaccgacgataagggcggtgatgatgccggtgacggtcatttggttcctcctcgggggtgaagcttgttcggttgcgtccgtcgagccccagagttcccgaccccgagaaaactcaaaccgcctattttttggtcccttttggatcagccgcctcggtggtggaaagggcggcgatgaaggcctcctgcggcacctcgacccggcccaccatcttcatccgcttcttgccttccttctgcttctccagcagcttgcgcttacggctgatgtcaccgccgtagcacttcgcgagcacgtccttgcggatcgcccggatcgtctcgcgggcgatgatccgggagccgatggccgcctggatcggcacctcgaactgctggcgcgggatgagtttctgcagcttggccgcgatcgtcgtgccgtagctgtacgccttgtccttgtgcacgatggcgctgaacgcgtcgaccggctcaccgtgcaacaggatgtcgaccttgaccaggtcggccacctgctcaccggacggctcgtagtcgagcgaggcgtagcccttggtcttgctcttcaactggtcgaagaagtcgaagatgatctcggcgagcggcagggtgtaccgcagctccacacgttcggaggacaggtactccatgccgagcagggcgccacgacggctctggcagagctccatgacggccccgacgtactcgttgggcaccaggaccgtggcgcgcaccaccggctcgtggatctcggcgatcttgccggccgggaactcgctcgggttggtgaccgtctgctccttcgcgtcctcggtgaccacctggtagaccacgttcggcgcggtggagatcagatccaggccgaactcgcgctccaggcgctccccgatgatctccaggtgcagcaggcccaggtagccgacccggaacccgaagccgagcgcggccgacgtctccggctcgtaggtgagcgcggcgtcgttgagcttgagcttgtcgagtgcgtcacgcagcgccgggtagtcggagccgtcgatcgggtagagacccgagtagaccatcggcttcgggtccttgtagccgcccagagcgtccttggccggccggttgttgccggtcaccgtgtcgccgacccgggactggcggacatccttcacaccggtgatcaggtaacccacctcgccgaccccgagggcgccggccttctccatctccggcgagaccacgccgatctcgagcagctcgtgcacggcgccggtggacatcatcttgatccggtcgcgggcctcgatccgcccgtcgatcacccggacgtaggtcaccacgccgcgatagacgtcgtagaccgagtcgaagatcatcgcgcgggccggcgcggtcgcgtcaccgaccggggcctggaactgccggacgatctcgtccagcagatggtccacgcccactccggtcttgccggagacgcgcaacacgtcgccgggctccacgccgatcagcttcgccagctcctcggcatacttctccggctgcgcggccggcaggtcgatcttgttgagcaccgggatgatgtgcaggtcgttctccatcgccagatacaggttggcgagggtctgcgcctcgatcccctgcgcggcgtcgaccagcagaacggcgccctcacaggcggccaggctgcgcgagacctcgtaggtgaagtccacgtgacccggagtgtcgatcatgttgaggacggcggtctcgccctgcttgtccccggcccggaccgtccagggcatccgcacggcctgcgacttgatggtgatgccgcgttcgcgctcgatgtccatccggtccaggtactgggcgcgcatctgacgtgggtcgaccaccccggtgatctgcagcatccggtcggccagcgtcgacttcccgtggtcgatgtgggcgatgatgcagaagttgcggatgcggctgggatcggtcgatccgatcacgttcacgccggggtcgagcggtccaggcacggtcgtccgttctcttcaagcgggtgtcgtcaggcgggcctccgtgggctccgcgagcgccggcccgcagaccggcgctccctatcgtcccacgcccggccgggcaggtccgatcacacccgttcgagcgggccggtgactcccggcggaggctcggccacaaccggatccccgggccggatcaccccaccacgcagcaccacggccatcaccccggcccggcggaccacgttcccggcgtcgtcccggccgaggacctgcttgagcagcccgctccggaaccggtcgatctgcgcacacggattccgcagcccggccacgacgatcgccgcccgcggatccgcaccgtcgtgctcgcgatcccgccgcagcgccgcggccaccgcctccacggcccgcgcggtggcctcgtccagcgtcgccgcctcggctagctagctagggcgcgcccgccggcgccgggccgaagcgcaggatcgtgccgcgcggcagggcgagcaggtcgatcccgcgggtcgtcacgttctcgccgatgccgccggccggcacgtcgaaacccttccccgccacctcgtcgaacagctcggcctggatcaggtggacctggcgcaggttcggctggctcggatcggccgccacccggctccgatgccgcacgttgaccccggcgtggatgtccccctccacgccccagccctcgaccaggacgatctcgtcccggttcggcttcgtgaacgtgtaggcatcgttccggctgaccgcggcaactgtcgctgaatcaccactcatgccctgagtctggctaatcaccccctccccgctcgaccccgtttcccggctggcgacgccagccccctgatccggggcgggacccgtccacggtcaggggcgactccaggcggcgatcccggcgactcccgccctcagtccggtggctccaggaacagcgccgacagcttcggcagacggcggcgcatctcgtcctcgttgtcgaagtcccacaggtcgtcgaccgcgggacggatccggggccgctcctcggccggcaacggctccccggtggcctgctcataggcccgggccgcgatgccgagcacctcctcggcctcgaagaccgcgccggaatccgcggcggccttgatcacctcgacgttggccagcacgtcgggacgctgcacggcggcggcgaccgccttgcgcccgtgggcgatcagccagccccggaacgcgtcgaacccggcctcgtcggccccgctgttgatcagataggccgcggcccagagatcctccgtgccggaggcggccatcaccttgtcgaggtgacgcccccaggcgacgatctcctccggatcgtgcgtggccagctcggcgacggcacgctcggccaccacggcgggggacgccggccgatcggtggtcgcgcggtcgatgaccgcccagaaatcgtcggttcgcatgccacggatcctgccagtgccctccgacattttcggcggcgaccggcggggcaggatgaagccatgcggccgatcactctgcccgacgttccgtacagcgctaccgccgtacgcccgcaatggcatgaactgccggagaccgtgcgggaagcgatcaccgagcgcctcggctcgccgatcgtcgccgcgcgcagcgcaggcggcggtttcacccgtgccttcgccgccgtgctcgacaccgaggccgggaccggcgctttcgtcaaggcagcgccgttgagcgagcccacttcgcagtggtacgcccgggaggccgccgtcacgtccgccctcccgccggaggtcaccgcggcccgcccgatcgcgatgctgaccgtttctgactggttcgtgctgtgcctggaggcggtcgacggccggatcccggagctgccctggacccggccggacctggacgccgcactgcgcacctggtcggccgcggcgaccgctttggcctacccgtccccggccctgctcgccgtcggcctgccccgcctgccggacattctgcgcgacgagatgtcctggtggtcgctgatcgcgaaacgccgggagccgatgccggagccggcccgcgacaccatcgcgccggcccgcctagcggacctcgccaggctcgaacgcgccctgcccgacctggccgcgggcgaccacctgctgcacggcgacctgcgcctggacaacgtgctgatcgaccgggacggccgggcctggctctgcgactggacctggccgtgcctcggcgcaccctggttcgacacggtgacgttgctggtcagcgcctacgccagcggcgcggacacggatgcggtgctgcgcgcctggggcgccccggacgacggggtggacggggcgctggccgccctcgccggatactggctggtccgggccggcggcgggccgagcagcgcctccccgcacagccgccagcaccagcggttcagtggccgggccgcgctcgcctggctcgccgaacgccgcggctggtccgccaccccgcccagcactccggggcggcccgccccggagaagcgcggctggcttcgccgctgaccaccgcactgtgaccacgaccacggcagcggccggagtgcgccgctcgctccctgcgcagccggcacgtcctggatgtccacgccctggtcaccgccgcgcaggccgacgacccggcacgcgacccgaccgcagtgagccgctcacccgcgaacagccggcacgcccggaggtccacgccgccggccgcatggcgaaagcccacagtgcgaaaggccacagtgccgagcccgcccacgcacggaaggcctgcgccggcacgaagcagtgcgggcagcatgggcactgcgggcagcatgggcactgcgggcagcatgggcactgcgggcagcatgggcactgcgggcagcatgggcactgcgggcagcatgggcagtgcgggcagcatgggcagtgcgggcgaacgtgggcatggcgagtagacgtgggacggcacgcgggggcgcgggcgccgcgggacagcgccggttagcgggctcggggcggcccgggacggagtcgttttggcggctcggaggcgtcctggtaatctgtttcttcgcgtgtggtgacacgctgttgttttctgcaccggcttcgccgggtgagacggccgcgcggtgaccactcgttgagaccattttccgctctagtcaggacaaggctgtcgcgtggcgaacatcaagtcccagatcaagcgcaaccggcagaacgagaaggcccgtctgcgcaacaagtcggtcaagtcttcgctgaagaccgtgatccgcaagctccacgaggcgagcgacgcgggcaacgtcgagacggcgaccactctgctgcgtgacgcctcgcgtcagctcgacaaggctgtcagcaagggcgtcatccacaagaaccaggcggccaaccgcaagtcggccatcgccaagaagatcgcctcgctgtccgcctgatcctttgatcagatcggcggtcgcacggatgcgaccgctggctccgcccgccggcgggcgggcagaagacgaaacccgggcatcgcgggaccctcacggtccccgcggtgcccggttcgcttttcccgcgtacggtcatgtcccgccagccccgccctcctcagggtcgacccccgggttcgggctcagcaacgtctccggatgcccgcctggcggccacctcggcgccaccgcgctcagcggctcagtgcctcgccccgataccgcacgacacccgtgcggggcgtcgcagcgagatgacgaacccccgcacaccatgccgtgagcgactacatagcgatacggcaggccctgccgtgacacggtcgtccgaggctccgcagcgacatgacagagccccgcacgacagtgccgtgcggggctctgcaacatctgtctattcgtaccggcgtaccgctgactgccgggccatctgctgacggacgccgacatcgtcggtccgcgcgcgccgcaccggcgcggtgttgaccgccgggcctccgtgccggccgtgtccgccctccgcgaagcgcccgtccgggactccggctccgtatcccgccgcacccccgtccgagatcgcggaaccgaccgccccgggccgccccgaccccggcgccagaaccggttctcccggaccaccctggccgcgcggcgcgaacgggccggccggcccatgccgaccggcgtgcggagcacccgcggacgaggcattgcgcccggacgaggaaccagcccccgggtcagcgctcggcccgttccacctcccggcatccgaaccaccgtccggaccgttccaagacccgggacccgaaccgccacccggaccgttccacggagcggagcccgaaccgccacccggaccgttccacggagcggagcccgggccgcccccggagttgacgcccggcccggcgggcggagctccgacaggccgacgcccgtacccgttctccggcggaaaccagaccaccccggtcggccgggcgtccaccggcggcggcgccaccggggtccggacccggaccggcggccattccggcgcatgcccggcggtctgcggccgatgggtgtggcgttccgcacgctgaaccgcggcccgcgccgccaccggctcggcggccgatgcgggcggggacaaccagccggccaccacatcgttgaacttgaccatcgccgccaccaccatcggcagcaccagcacaccccaccagctgaccagttcggccagcgcgagcagtacaccgagcgcgatcgcgccttcgaggaacacgaagcagagcaggccgccggggctgaggtggcgcagacccagcatccgggcgtagagcggctggtgcgccgccccggtccgccgggaacggacggtacgggtcatcggacggcctcgccccggcgggcggcggccaccgcgaagatcgcctgttccagtgcgtagccgcggtcctcggcgccgcccttgacggccgcgttgcagtcggcggcggcgcgcatcgcgtcgaccaggccgtccggggtccagccgcggctgcgttcctgggcccgctgaatcttccacgccggcatgccgagcgtgctggccagctggtaggggttgcctttgccggctgaggcgacccgggccacggtgcggacgccgtcggccagcgcgtccgcgatgggcaccgggtcgaccccgacgtgcagcgcccagcgcagcgcttcgagggcgccgggcagatcgccgatcatcgccgcgtcggccaccgtgaacccgctgacctcggcccggcctttgtagtaccgcgcgacgaccgcctcggtgaccttgccgtcggtgtcggcgagcagctgcgagcaggccgcggcgatctcccgcagatcgttgccgaccgaggccagcagggccgacgcggcagcctcgtcgcaccggccgccggcccggcggaactcgtcgcggacgaacgcgatccgttcccggtcgtttttcagcttcatcgccggcacgacggtggcgccggctttctgcagcccgtcggcgaacgccttgcctttggccgcgccgggatgcgtcacgatcagggtgacgtcgggatccggattcttcgcataggccagcagcgcggcggccagctccttccgcgcgtcctgaccgttgcgcaggaccagcacgcggcgcccgccgaacagcgaggggctcagcatctcggcgatctcaccggggctgagctggccggcctcatactcccggacgtccgcgcccggctcggcgacgcgcgcctccgccaccgccgcggcgacggcacgggcggcgagtagctcctcatcgccttggacgagcagcaacgagggtggtggcgcggcgttcacgtcggacatcgtcgcacgtcccaccgacagtccggcgaggctcactcttcagcgcaggcgatccgatcactgaacgcgaaacagacatatcggcacaccggcatgcttcgcatgctctgacctgcaccgccaggaatctcacggaagattcacagtagggtcgaccccctgtcgtgcgtacgcaaaaatgcactttaaaccggcatgtcgcccaggatccgcgcggttcccccgagccgccacgaccccgcctacctgtcgttcaccccacgcgccgtgaccgcaagcccaccaacctgcgtgaccaccgcaaggtcccccgattcgtccgtacgcatcacccgcgccccgtcccgggccagccgcgccagcagcgacagattcgggtgcccgtagtcgttgcccacccccaccgacaccagcgccaccgccggatcgaccgccgtcagcagctccggtgactgcagcgcactcccgtgatgcgccaccttgagcacgtccgcccgcagtccggccgcgcccacccgcgccaccaggtcgttctgctcctcggtctcggcgtccccggggagcagcacggtccggccgcccagggtcgcccgcagcaccagcgagttgttgttcggatcggagttcgtcccgcgcaacggctccaccggcccgagcgcgaccagccgcacgccgcccacctcgtacgcccaaccgggtccgaccgtcagcaccggcgttccgcccgcccgcgccgcctccgcgacctgccgccgcccacccgccggctccggccagtccggcgccaccaccgctgccaccgcccgcccgcggaacaccccgtccaccccgccgacgtgatccgcgtgatagtgactgaccacgaagagcgccacctgccggacccccagccggcgcaggcagcggtcgaccggatccgggtcgggcccggcgtcgaccaccaccgcccggcccgtgccggccggcagcaccacggcgtcgccctgcccgaccgaacaggccacgaccagccagtgcggtggcggccagccgggggcgagcaggcggaccggcaacgcgccgagcaccgcgcacgccgcgaccacggcggccagcctccggaccacggcccgccgcgccgcgatcaggaacgccaccgtgagcccggccagcagcaacgcccccggcaccccggccggccagggcagtgcgccggccggcacccgcgccccggtccgggcgaccagcaccagccactcggccggccagtgcgcgagccaggcggcgaacccggcgccggccggccacaccggcgacagcagcgccgcggccaccccgagcagcgtggccggggcgatggcgggcaccaccatcaggttcgccggcaccgcgaccaggctgaccgtcccggacagcccggcgatcaccggaccgcaggccacctgggcggccgccgggacggccagggcttcggcggcgccggccggccagccccgggcccgcagcgcctcccgccaggccggcgcgagcagcagcagacctccggtggccagcacggacagcgtgaacccgggatccgcggcgagctccggatcggccagcagcagcaccgcgaccgccgcggccagcgcgggcaccgccacccggggccggccggaggcgagcccgagcagcccgatcgcgcccatcgcggcggcacgcaccacactcggcgacggccgcgccagaatcacgaagccggccagcgccaccccgcacacggctgcgcagagcaccggtcccgcccgggtacggcgtaccgcgaaaagcaccacccccaggatcatcgcgacattggcaccggagacggcggtgaggtgcgtcatgccggctgtctggaagtcggtttcgagccccgggtcgagccggctggtgtcaccgacgaccaggccgggcagcagaccgccggagtcggccggaagcggcgcgcaggcccgctgcagcccggcccggagcacgcccgcggcccgctgcgcccacgacggctcaccgatcaggcgcggtgctcggcgcaccgcgacgaccgccgcccgcagatcaccgggccggggcggcagcagtttcccggccgcggtcacctcctgcccgggcagcaggccccgccaccccggatcgctgcccagcaccagcgcccgcgcggacagccgcatcgtcatcccgctcccgacgacacggaccgtttccagatcgacggccagcagatacgtcggtggtcccgccgccccacgcaacgcccgcgggtcgtcccggaccaccgcccgcacctcgaccggctcgccggacgcgatcaggccggccagcgggcgcgcctcccgcacactgagccgggccgcggtcgccacggccccgcagccggcgcccagcgcgagggcgatcacgatccaaccgagcgcagggccgatctccgctctccccctccccggtgcccgccctcccgcctccgtccaccagatcgccccggccagcgcgcaggtcccggccaccagcagcgccaccccgccgacgagcaacccaccccgcgccggcagatgcaacgcccccagcgccgccagccagacccccgccatgaacccacccagccgcagatccggcacaccccgcccacgccggcctccgaccgcctttccaccggtcgacgcggcgccaccagccggcaccgccgccccggcggacccggctccatcagccgagtgcggcgacagacgaccgggagaccgcgacggatggaccgcaggccgcggacggccggagggcgggtgggcgctgccgggggacggacgcgtcccgctgaagggcggcagcgaaccgccggagcgggactgcgggcttccggatcgcggcaacgggccgtccggggtgggcggcgagccgtcggccggtggcgctgtcataccgtcaccagctctttgagctggtcgtagcgggcatccccgatcccgtccaccttgcgcaggtcgctgaccgcgcggaagccgccctgggccgtccgtgcgtccaggatccgctgggccagcaccgggccgaccccgggcagggtgtccaggtcggcgagagtggccgtgttcaggttgatcagcccgccggccgttccggaggcggccgggccggtgcccgcggtcgccgccgcgccgggtggcggactcacccccaccatgatcagttcgccgtcggtgaccttgcgggcgaggttgagggctgccacgtcgaccccgggctccgcgccgccggccgcggccagggcgtcagccacccgggaaccgggcgccagccggaccagacccggtctgcgcaccttgccgccgaccgccacgaccacttccgccgccgcgccggtcatgccgccaggaccgaccgcagcgccggaaccggcaccggaatcgggcctggcacctccggatccggaaccgctgaccccggagccgctggacctgccggaaccggtggtgcccgcaacgcccgtccccggcccgcccgagccggctccgaccgggtccacccgtggccgcgcccgccaggcgaggaatcccgcgatcagcaggaccatcaccgccaccgcgaagagcgcgcgcactcccggccggccggggtcgaaggcgttcagccagcgccgcgggccgctctcgtccgccccgaacgccccggcgccgggcagccccggctcggcggcgaccggaggctcctcggcagtccacgaataccgttcgtcgaacggcgcctcggcaggcggagctgacatgaagggcggcaccgacgaggagggcgctcccaccccggaagacagctcccggcccgatgccgaccccggcacaggagacgggccggagacagcagaggaccacggtggggaggaccacgctgaagcagacggcccggccggggaagacccgggcatcggcgggggcgccggtcgccgctcgaactccgccgctccctgcgccccgtcgatctcggaccaggccggaatgatgtccgaccagcgcaacggtccaccggtcccgctcagctccccgacaaccgccgggggcgccgagcgcagcgcccgcatccgggctgccacgacgtcgtcggtatccttcgcctctcgcacggggccgaagtctgctgcttcggcccacccgccgccggcagctctgtggacagcttcccagtgtggacaattcccacgatcctgccggatctgatatgaggcatggggacggcttgtgaccaggaacgaggcgatcagcctgctgcgcgccgcgggttgtgtcttcgccgaggaggaggccgcggtcctgttcgaggccgccccggatgacgcgacgcgccgcgcgctggtcggccgccgctgcggcggggagccgttggagcaggtcgtcggctacgccgatttctgcggcgtccgcgtccatctccgcccgggcgtcttcgtcccccgggtccgtagcgaactgttggtccgcaccgccgcgtcggaggcaacgaccagggccggcgatgaccacccaggcccgctggtggtcgacctctgctgcggctccggcgccctcgggctggcgctccgcaccgtcgtaccgcgcatagacctgcacgccgccgacctggaccccgtcgccgtcgcctgcgcccggcacaacctggggcagaacgtccatcagggcgaccttttcaccgctctgcccgcccggctccgcggccggatcgagatcctgatcgccaacgtcccctacgtcgccaccccccacctcccgtttctccccgccgaggcccgcgaccacgagccccgcaccgcgctggacggcggcgacgacggtctcgccgtcttccgtgccgtcgtcgccggcgcccgttcctggctggccccgggcggcctgctgctttccgagatcaccgaggcgcagaccgccccggcggccgccgtcgtcgccgggtacggattgacgcccgacgtcatcaccgacgatgatctcgacgcccgtgtgatcaccgcgagacgataggcggcgccgtggggctcttccgcagggtcgcccgcgcccggctggccagaagggtcatccggcggctgcggcgtgccggtgtccggggcgcgcgctatcaccgggccggtttcgaggtgcggttcaccctgccgggcgagccggagccgacgattctgccgctggccgctctggccggccgcaagcggcgcgaggtgcgcgaccacgtggcgggcatcctgcgtaccgccgatctcccgttacggtgggcggacgccgcgccgctgctgcggccggttcttcgcggcggcgcgccgggcgcgccgttgcaccgcccggcgttgcccttcctgtccgagttcgtcgtggtcgatcatccggacaccatgacgtacgtctccccggcccaactggcggcgtgggaggtgaccgccgaggccgtcttcgccaccgcccgggcgaaccttccgggcgcgtcgctgcacggcgccccgtccggccgcccggtcgtggtccggttcgtcgacgacggcaatgcctactggacgtcgcatctgctgctgcccggctggctgtcccggctcagcggccaggtcggcggggttccggtggcgttcgccccggagcgcggcaccctcctggtcaccgcggacggcaccgagctgctgccggccctgttcgcgcaggcggaggagatcttcgcgaggtcgtcacggtcgctgaccccgatggcctatgtcagcgatccggatggctgcacggtcccgtatccggcgccgccggggcacccgttgcacgcggtggtggcgcgcgccgagcggatcctggcggtcgaggagtattcccggcaggcggccgggctgcccggcgccgcggagatcgagctggccggtgagcggacccgggcgttgtggccacggaacaccccggtgctgctgccgacggccgacgaggtgcgactcggcgaccgggtggtgccctgggcggacctggcgttgaccccggtggagggtctgagcccggcgcgctggcgtgccgagggctggccggagggggcgggctagtcccggcggtgcaccaccacaccggccagtcccggcccggtgtgtgccgccaccaccgcgcccacctcggtcaggtagcagtcccgcagccggtcgcccagccgcatggtgatcgcgtccaccagcgccgacgcgcgttcgggggtttgcaggtggtgcaccgcgatgtccgcctcgcccggcccggccgcctccaccgcgaggtcgacgagccggctcagtgcccgccccgcggtgcggaccttgtcccgtacgacgaccgccccgtcgacgacatgcaggatcggtttgaccgacagcgcggtgccgagcagcgcggaggccgccccgatccggccgccgcgccgcaggaattccagggtgtcgacgtagaacagggtgctgacccgggccgcgtgctcgaccgtgatccggtggaccgtctccaggtcgtgcccctgggcggcggccgtggtcgcggcgagcgccgggaagccgagccccatcgccgcggtcccgctgtccaccaccatgacccgggagccgacctcggccgcggcgagctgggcggcctcataggtgccggaaagtttggcggacaggtgcaccgagacgacgccgtcggcgccaccggccaggagctcccggtagacctcggcgaactgggacggggcgggccgggaggtgctgaccgagctgcgccggccaccgagggcccgggccacctcggccggggagatctccagcccttccaggccgtcccagccgttgatcacgacggtgagcggcacgatggtgaggtcgtaccgcccgttcagctcggcgggcagataggccgtggagtcggtgacgaccgcgatggtcatgcagcgaactctactgattgacgcccggcggcggatcagcccggcgtgaccgaggagaccgcgaacggctccccctgctggcaggtggtcatcagcccgggctggggcaccccggtcacccgcaccctgctcccctcggtgagctgcttgcgctgctccgggtcgctgatgatcagcaggtggttctgcaggagcaggcagccgggctcggtgcccacggcgaccgtcccgctgatcgtggtccccgccgcggtgttcccggggaccggcgccggggaggacggcgtgccggcacccggctgcccggtctgcgccggctgtgcgcaaccggcgatcgccagcagcagcgtcgccggcaggaggtttcgtcggatcatgccgatgggacgtctccggaccgcggacggttccgctagcgcacgcccacgttgtacgccaggagttgccaccccggcccctcctcgtgggtcagctcgaaccagtgacagttgtgcaggccgcgcagcgtccgcacctgttcgcgcggccagccgagcagctgaccgacgccctgccgggcggccgccccgtgggtggccaccacgaccgtctcaccgggggcgagcgcggccgcgtcatgcagcgcgtcgctgacccgcttgcccaggtcgtcgagggtctccacaccgccaccgacgacgtccgccccggctttccagcgtgcgaactccgccggccgccgcgacgccacctcggcggtggtcagcccctgccactcgccgaagaaccgctcccgcagccgctcgtcgtggctgacgctcagtccggtgaccgcggacagggccgccgccgtcgacgccgcccgggtcaggtcgctggcgacgatcgccgccggctgccgctcggccaggaccgccgcggcctcggcggcctgccggcggccgaggtcgttgagcggcacgtcggcctgtccctgcacgcggcgctccgcgttccagtcggtgttgccgtgccgccagacgatcaggcgggtcacggggtgtcggtgccggccgcgcccgcgtcgaccatgtcccggtcgacgaacggaatggtcgggcagtccttccacagcttgtccagggcgtagaactcgcgctcctcggcgtgctgcacgtggaccacgatgtcgacgtagtccagcagcacccagcggccctggcgctcgccctcgcgccgggcgggcttcgccttctccggcaggttgaccagcgcttcctcgatggcgtcgacgatcgcgatcacctggcgctcgttggccgccgaggcgatcacgaaggcgtcggtgatgtagagctggtcggcgacatcgatgacggagatgtcctgcgccttcttgtcggcggcggcctgagcggccgtcatcgccagttccagggcgcgttcggtgacgggcaagtgaatcccctcggtcgacttcagttaccggtcaagtctctcacgcgggtccgacattccccgagtccagatagaggccccgcttgttgatgtactgaacgacaccgtccggcaccaggtaccagaccggcgagccggacgcgacccgctggcggcagtcgctggacgagatggccatcgcggggacctcgaccagtgtcacgcggtcggccggcaggttcgccgcgctcagctcgaagccgggccgggtcaccccgatgaagtgcgcgagacccagcatggtcagcgcgtcgcgccacgacatgatccgggccagcgcgtcggcgccggtgatgaagtacagctcggccgactggccgtagacggcccgcatgtcgcgcagcgtgtcgacggtgtaggtgggcccgtcccggtccatgtcggcccggctcacgtggaaacgcgggttggacgcggtggcgatcacggtcatcaggtagcggtcctcggcgggcgagacccggcccttctcgtacggctgcccggtcgggacgaacgtcacctcgtcaagctcgaagcgggcctgcacctcgctcgccgcgaccaggtggccgtgatggatggggtcgaacgtgccacccatgatcccgatccgccgtgctgacatccgagcaggatagagcagtcagccgtccagccgtttgcggacggcggcgagcaggtcgttcgaggtgaacggcttctccagcagctcgacgcccgggtccagggtgccctgtgaggcgagcaccggctgcgcgtacccggacatgtacagcacccgggtcgagggccgcgcgtcggtcagccgctcggccagctccttgcccagcatcccgggcatcaccacgtcgctgagcagcaggtcgatctcgccggtgtgctcggcggccaggtccagtgcctgccggccgcagtccgcggtgagcacccggtagccggccgcggtgaggatccggccggcgacgtcgcgcagcccgtcctcgtcgtcggcgaccagcaccgtctcgccgttgccacgggtgacggccggttcggcggtctccgcggccggagcgttctcctcgccggccggcagcagcacggtgaccgtggtgcccaggccgggctcgctggtcaggctgacctcgccgccggcctgggcgaccacgccgtacacggtggccaggcccagtccgctggcctcacccttgggtttggtggtgaagaacgggtcgaaggcgcggtcgagcacgtccggggtcatcccgcggccggagtcgcagacccgcagccggacccggtcgccgaggcggtgcgtgtcgatcaccaggttgccgccggacggcatcgcgtcccgggcgttgaccgccaggttgaccaggatctgctcgatctgcccggggtcgaaggtgatcgacggcagatcggggccgggccggacgatcagcgtgacgtgctcgcccagggtgcggcgcagcagatcctcgacctcggtcagcaccgtgttgaggtcgagcggctgcggccggaccacctcgcgccgggcgaaggcgagcaactggtgggtcaggtcggtgccgcgggtgccggcccggaccacctgctgggcgtcggcggcgatcgccttgaggtcgggttgcggggactcggcctcctcgatcacgaagttggcgtagttgaggatcacgccgagcatgttgttgaagtcgtgcgcgatcccgccggccagctggcccaggctttccaggcgctggctgcggtgggcgtgtgcctcggcccgcagccgcgccttctcctggtccacccggatccgctcggtgaggtcgcggaccacggcgacggcgagccggccctgcggcgtctcgacgatggtggtggacgactcgaccgggaattcggtgccgtcccggcgccgggcggtggtggtcacggtgccgatcgagccgggcggcgaggtgtcgatcacctgttgccgccggcgcaccagcgcccgtgactcctcggtgagcagcacctccagggactggccgaccagctcggtggtgggccagccgtagagttgcccggcccggtcgttgaccagggcgatccgcaggccgtcgaagaccaggatcgcgtccggtgcggcctgtagcaggccgctggacaattcagcggaccattccacgcattcacccccgtatcgccaggttacggggtcggaacggataaaaccgcagaattcagcaggcctgcagggcgcgtcgcatgtcgtcgtcgtggtcctgcaccacccggcgcagcagcgggtgcaggtccggccgggccagcagcccggcggccagccgccgggtccgctcggcgaccatcaccgccgggtacgccgcgatcgccgccttctcggccgccatcccggagcggatccgcatcatctccggcatgtcggtgaagtatcgctcgacgtacggctccagcagctcgcgctgctcgggctgccagaagccgagcgcggtgagctcggccatccggttggacaggccggcgtcgccgaccacggcgctccaggccgcccgcttggcggcggggtcgggcagcgcggcccggcaccgggccgcccactgctcgccgccgacggtccggtcggcggccagctcggcctcgatcacgtccggcccggccgcaccgagcacggcgagccggtagacgatcagccagcgcaggtcggcgtcgacgaccaggccggccggcacgccggcgccggtcagccagccgcgcagccgagcggtgtcgatgccggcgccgatcagcccgcgggccgccaccagctggcgggagctgcccggcgcggacccggcgagcaggcggtcggcggcctgggcgatcatctcgcacgcggccgggcgggtctccgcggtggcgtagcggtcgaccaggccccgggtggcgcgcagcacgtcctcgacgatcaccgtctcggtctccaccggcagcgcggccagcaccagcgtgaccagctcggcgaccgggcgttcgccgtcgaccacggcgtccagcgtgccggcccagatcaccgcgcgcgcgagcgagtcggtgatcagcggcagcagcagcgggacggcggccgccgaggcgtcgtccaaccggatcttcgcgtacgccaggtcgccgtcgttgagcagcagcaggtcggcggcgcgcaccccggccagcgcgggcagcacggtgcgcccggtggcctccagctccacctcgatcagctcgcggcgggtcacggtgccgtccggcgcgtggtcgtagaggccgatcccgatccggtgcggacgcagcgtcgggaagtcgtccggcgcggtctgcagcaccgcgacctcgcggtaggcggcgccgtcccgggtcacctcgacgcgcagcgtgttcacctgggcccggcgcagccacagctcggcccagccggacaggtcccggccgctgcccttgctcaacgcgccgagcaggtcggcgagtgtggcgttgccgaaccggtgcgcctcgaagtgcgcgttcagcccggccaggaacgcctcgtcgccgagccacgcgaccagctgcttgagcaccgaggcacccttggcgtacgagatgccgtcgaagttcatcagcgcctgatcggtgtcggtcacctcggacggtgccaccggatgggtcgagggccgctggtcggcgcgcaggccccaggccttgcggtgcatggcgaaggtggtccaggtgccggtgaaccgggtcgcctcggccgccacccgggagcccaggtactcggcgaacgactcgttcagccacaggtcgtcccaccaggccatggtgaccaggtcgccgaaccactggtgggccatctcgtgggcgatcacgctggcccggtactcccgctcggactcggtcatcgcggagcgcgggatgtactcgtcgcggaacaccaccagccccgggtactccatcgcgccgaagttgaactccggcgcgaaggcctgctggtagtgcccgaacggatagcggatctcgaacatctcgtgataccggtcgaggcaccgcttggtgacctcgaagatctccggggcctgcgcgtcgagctgatcggcgagggtggcccgcacgtacagcgccagcgggatgccgtcgtgctcgtcggtgcgcgcgtgccagggaccggcgatcagcgaggcgaggtaggtggcgatccgctcggtcgacgcgaactcccagcgaccgccgtcccggctgaccagccgcccgttggtggccaccgtccaggcggccggggcggtgacgctgacccggaacgacgccttcaggtcgggctggtcgaagcagggcagcacccggccgccgttgttgatgaacaggtgctggtagaggtagaccgagccgtccgccggatcggtgtaccggtgcagtccctcgccgctgttcgaatagcccatggtggcgtcggtgaccagcacgttctcctcggccaggccggtcagcgcgagccgcccgccgccggccgcggcgatcggcaccggggccccgttcagcgtgatcgacgcgatcgcgaccggctcgaactccaggaaggtggcggcgccggcgcgggcccggaaacggacgacggtgacggcgcggaaggtctcaccgtccccggtgaggtccaggtcgacgtggtagctctcgacgtcgacgagggacgcccggtcggcggcctcggcgcgggtcagggtcggcatgacgacaatcatgccggtaccgggcgcggcgcggtgcgcccacctcgatgcttcccttgcccaccgccggcgcaggcgctaatttcggtgcatgcgcgttttcggtaggaactggtggcggccctgaccgggcggccccttcccacgcgctgatcactcatccgcggccgccccacccgggcggccgttgcggtttcatcgtggcactccgggtcgggcggcctccgtacccccgcaatcggagacctgccatgacgaccaccgtgaccgccgcgcccgcctcgacccgccgcctcagcggttttcaaccgaccggccacctgcacctgggcaacctgctgggcgcgctgcgcccgctgatcgcggcgcagggcgccgcggagtcgatcgccctcatcgccgatctccacgcgatgaccgtcgaccacgaccccggggaggtacgtcgtttcacgctggagcaggtgagcgtcctgctcgccgcgggtgtcgacccggaacgcaccccgatcgtgctgcagtcgcaggtgcgcgagcacactgagctgcactatctgctggaatgtgcggccgcgtacggcgaggcggcccggatgatccagttccgggagaagtcggcggccggcggcccggtccggctcagcctgctcacctatccggtgctgatggccgccgacatcctgctctacgacgtcacgcaggtgccggtgggcgaggatcagaaccagcacctggagctggcccgcacgctcgccaccaggttcaacagccgctacggcgcgaccttcacggtgcccgagggggtgcgtccggacgccacggcccgggtgatggacctggccgagccgactacgaagatgggcaagaccaccggaaccggacggatcggactgctggactcccccgacgtgatccgccggaccatcgcgcgggccgccaccgacacgctcggcgtggtccgccgggaccgcgaggcgcagcccggggtgaccaacctgatcgacatcctggccgggatcaccggcgcgcggccgtccgacgccacctcctacgccgccctgaaacgcgaggtcaccgaggcggtgatcgccctgctcgcgccgttgcaggcgcggcaccgagagcttcaggcacatcccgatttcgtacgaggggtgctcacggccggcgccgagcgggtgcggccgatcgccgccgccacggtcagccgggcacgccaagcaatcggactattggactaaggcaggcagcttcttctcgaaacacacgctccccgggttgccggcatagtgcccgaaggcggggatctgccggtaaccggaggactggtagagggcgatcgcggccggcaggtgaacaccggtctccagacggatcaccgggcggccggccgcgagcgtctcctcctcgaccgccacgatcatctcccgggccagtccgcgaccgcggtgagccgggcggacgtacatccgcatcagctcggcgacgccgtcctccagggcgcgccaggcggcacacgcgaccgcacggctgttgaccacgccgatcagatacgccacgtcgtcgtgcggctcgaacatcttgcccgcgccggtggcggacccggccagttcgcgctgctgagcagtgacgagggcggcgagttcggggtccagggcgggacgcgattcgatcagcacggaggtaactctaggtgacgtccgtttccggagggttgcgcggaactggccgatccgctattcgtcggtgtcgtcctcgtcggtgatcagcaccggcacctgcggattggccaccgcggtgaccgtcccgtcggaggccatgtgcagcacctcgtcctcgttgcggatccggcgggccttgcgggccgccaggcgctgcgcggccgacgggcgcacgtcctgctcctccagccgggcgtcggtgccgcgcgggccggagacgaactcgccggcattgggctgccagtcgaactcgcgggcgccgatccggaccgggtcaccggcctgggcgccgagcttgccgagcttgtcctcgacgccgagccgctccagccggtcggccaggtaaccgaccgcctcgtcgttgtcgaagttggtctgcttgatccagcgctccacctgggcgccgcgcaccacgtacacgccgtcgtcgtcgcgctcgacggtgaagccggtgtcgtcgaccgcccgcgggcgcagcaccagccgggtggcctcgaccaccggcttcgcggcccggaactcggcgaccgccttggccagggcgtaggtgagctcccgcaggccctcccgggtcaccgcgctcacctcgtacacctggtagccgcgagcctccaggtcgggccgggtgatgtcggccaggtcccggccgtccggaatgtcgatcttgttgagcaccaccaggcgcggccggtcctccagcccgccgtaggcggccagctcggcctcgatcgcgtccaggtcggccagcgggtcccgctcgatctccggggtcgccgagtcgagcacgtgcaccagcaccgaggtgcgctcgatgtgccgcaggaactgcatgcccaggcccttgccggtggccgcgcccgggatcaggccgggcacgtcggcgatgacgaaggtctcctcgccggcctgcaccacgcccaggttcggcaccagggtggtgaacgggtagtcggcgatcttcggcttggccgcggagagcaccgcgatcagcgacgacttgccggccgacgggaagccgaccagaccgacgtcggcgacgctcttgagctccagcaccacgtccagctggtcgcccggctcgcccaactcggcgaagcccggcaccttgcgccgggtgttggccagcgcccggttgccccggccgccgcggccgccgcgggccacctcgaactcggtgcccgcaccgaccaggtcggccagcacctcgccgtcggcggtctgcacgaccgtgccgtccggcaccttgagcacgagatccttgccgttcgccccgtcccggttcgccccggcgccaccgccgccgttgctcgccttgacgtgcgggtggaagtggaagtccagcagggtgtgctgctgcgggtcgacgaccagccggatgctgccaccgtgcccgccgttgccaccgtccggaccgcccagcggcttgaatttctcccggagcacggagacacagccgtgcccgccgtcacccgcctgcagatgcagcacgacccggtcgacgaacgtggtcacttcagctctcccttgccggtcacttcaccaaacgcacagcgggccgcggacccgagggtccacggcccgctgagaagaaaaactactccgcgaccggcacgatgctgacggtcttgcggccacgcgcggtaccgaacagcacattgcccgcggcgagcgcgaacagcgtgtcgtcgccgccccggccgaccaggtcgcccgggtggaacttggtgccacgctgacggatcaggatttcgccggccttgacgagctggccaccgaaacgcttgacgccgaggcgctgggcggcggagtcacggccgttacgcgagctggatgcaccctttttgtgagccatgtctacgcctacttcccgctcttgatgccggtcaccttgacgcgggtcagcggctggcggtgaccctggcgcttgtggtagccggtcttgttcttgaacttgtggatccggatcttcggacccttggtgtgctcggcgatctcgccggacaccgtaacgttggcaagcttggccgcgtcggtcaccaggttgtcaccgtcgacgaggaggacggcggcgagcgtcagagcgtcgccgggctctcccacgagcttctcgacctcgatcacgtcgccctcggcaaccttgtactgcttgccgccggtcttgacgatcgcgtacataggacgcggactccctgagacttacgcagccgggaaaataagctgctggcggatactgcttggggtcccgttggtggcggtcgagccgcggtacaccggaacaggcgccgaaaaagcgccgtcggcaagcctacttcatcggcgcgccgacaccaaaacggggttagcccctgccgcaggccgcgtcgagttcggcgtgcaggtcggcgagcttcttgtcgtcgatcttggcgacgtcacccttcagagcggtcacctgccggcccatcgcgtccagcgccttcttgaccttcgggtcggaggtgagcttcgccatgtcccgcagggcgtacgagaagctgtccacgtcccgcgtggccttctccttggcctgggccttggcggtggccccgcccgaggcggcgtcgatcagcagccgatagtcggcggcgaaggtggagccgaagctcgtgctggtccgggcggcctgcgcgcagatcgacgcggtgtcggcggagagcgcggcgtcggctagctagctagcgccggctgtgccggcggagcctcggtccgggccgccgcggccaccgccttcacctgggtcgcggccggcgcggcgccaccgccgttggaccgcctctcgggcaccggctcgtgatggatgatcacgccccggcccttgcagtggtcacaggtctcgctgaacgcctccagcagcccggcgccgatccgcttgcgggtcatctgcaccaggcccagcgaggtgatctcggtaacctggtgcttggtccggtcccggcccaggcactcggtcagccggcgcagcaccagctcgcggttgctctccagcaccatgtcgatgaagtcgatcaccacgatgccaccgaggtcgcgcagccgcagctgacgcacgatctcctcggccgcctccaggttgttgcgggtgaccgtctcctccaggttgccgcccgcaccggtgtacttgccggtgttgacgtcgaccacggtcatcgcctcggtgcggtcgatcaccaggtggccgccggagggcaggaacaccttgcggtccaggcccttgaggatctgctcgtcgatccggttctcggcgaacacgtcacccacgccgacgtgccggtgcagccgctcgaccaggtccggcgagaccgagtggaggtagttctccacctcggcgtacgcctgctcgccctgcacgatgagctcgcggaagtcctcgttgaacaggtcccggaccacccggatgaccaggtcgggctcctcggagagggcgcgcggggcgttgccctcggcggcccgcgcctggatgtcctcccactgcgcctgcagccgcttgacgtcgcgggccaactcgtcctcgctggcgccctcggccgcggtccgcacgatcacgcccgcgccgtccggcaccagcttcttcaggatgtcccggagccgcttgcgctcgttgtccggcaacttgcggctgatcccggaggcgttgccgttgggcacgtagaccaggtgccggccggagagcgcgatgtggctggtcagccgggcgcccttgtgaccgatcggatccttggtgacctgaaccagcaccgagtcaccggagcgcagcgcctgctcgatcgagcgggcccgaccctccagcccggtggcgtcccagttcacctcgccggcgtacagcaccgcgttgcggccccggccgacgtcgacgaacgccgcctccatgctgggcagcacgttctgcaccttgccgaggtacacgttgccgaccatggtgcccgaggtggcccgggcgacgtagtgctcgaccaggacgccgtcctcgagcacggcgatctggatgcggtccggcttctgccggacgaccatcacccggtccaccgcctcgcggcgggccaggaactccgactcgctcaggatcggcggacgggtacggcgctgctcgcggccgtcccggcggcgctgacgcttggcctccagccgggtcgagccggagacgccctgcacctcgtcggaacggcgcggctcacggacccgcaccacggtgtgcacaccgtcctcgatgccaccggtctcgccgtccccgctcgaacccttgcgccgacgacgccggcgacgtcgggtgaccccgccctcgccgtcctcggactcctcgtcctcggcctcctcgtcgtgcgcggcctcggcctcgccctcggactcctcggcgtccaggtcggcgtcgtcggcctcgtcggacgggcccttgccccggccgcggccacgacggccccggcggcgacgacggcggccaccggcctcgtcgtcgtccccgtcgtcctcgacaccgtcctcggcgtcgtcagcggactcgtcactctcgtcgatctcgtccagcaccggctgctcggccgcggcggccaccggctcgggggccggctcctcggccgcgccacgacgccggcgacggctgcgccgggtgccctcggcggctagctagctagccggcgcgacctcggtcgcctccggcggcatgaacagcaccggcggcggcagcggggccttgcgggcccgggccgggcgctgcccggcgggctccgcctccgcggcggcctgctcttccgcgggctgctcttcggcgggctcctcttcggcgggctccaggaagtcgtcgtcgagcgggaggatcccgacgatcggcacctcggggctctccggcggcgccaccggcgccacgggagcgggcgacggctcggcggccggcgggatctccagctgctcggccgggggcgcggcgaccttgcggcggctgcgcgtggccttcttcaccggagccggcttctcggcggtctcggccacggcctccgccgccgcctcctccgccgcagcggccggagccgcctccggggcaggctcggccaccttgcggcggctccgtgtggcctttttcaccggtgcgggagtcggctccaccacctcggccggggcggccgcggcagtctccgcgacctcctcagctccaggcgcggccgccttgcgacgcggtgcacgcgtccggcgggccggggtggtgccggtggcggcgtctacgggaggagtcgctgccccgtcccgttcaccgccctgttctcccaaggtgactgggggctcgttatcgagcatgggcgctctccagttctggcgaccccgggcgcgggtgagcgctgccacgcagggtcgctgcaaagtatttcgggcccgtccgagccggacgggctgccgaagtctgccaagtggacaccggccctgaacgggtcagtgtccgccgatgccgacgccctcgcgatccgcctccaacggatcgacgatctccccctgcgcggtgagtgtgccctgggccagccgggttacccgagggggaaccggcggctccaggccggccaccacgcgcaggccggagaggacgtcatcgggccgcacggcgggcgttacctgccgtacgacaaggtcgattatcgcacacggtactccaccggccccggaaggtaggtccggctctgctaccaccatgcacctggtcaccgcggcgcgcgcgtcgaacgtgcgccggccctgcttcgtcatgcgctcgaccagcacttcaccggccgaaaggaaggcctccacggcgtcccgggcggccgccggatccacctcgaacagctccaggcgccactgcgacgcgtcgatccggtcggccaggctgccctcgccggcccggaccgcctccagcacgtccaggccgggcgagagcgccgcgtccagggccagccgcagctgctccggatcgacctcggactgcaggccgatctccaggtactccgcctcgctgccgacgccggtgggcgccgcgctcgcgtacgagatcttcgggtgtggggtgaagccctgcgagaaggcgatcggcacgccggcccggcgcagggcacgctcgaaggcccgggcgaagtcccggtgtgaggtgaagcgcagcggtccgcgtttggcataccgcaggcggatccgctgcacgaccggggcctgaccgcccacgggctggttcttcgggggaatcgtcgctctcctaaacggggacccgcaggccgttcaccggggtcaggggaagaagcttcttaccggtcggaccgatctggatctcggtgtccatcgccgggcagacgccgcagtcgaagcacggcgtccagcggcagtcgtcctgctcgaactcgctgaccgagtcctgccagtcctgccagagccagtccttgtcgaggccggagtccaggtggtcccagggcaggacctcggtctcctcgcgctcgcgggtggtgtaccagtccaggtcgacgccgaggtcgggaagcacctcggcgcaggcctcgacccagcgggcgtacgagaagtgctcggaccagccgtcgaaccggccgcccttctcccagacccggcggatgacctggccgacccggcggtcgccgcgcgacagcaggccctcgatcagcgacggctcgccgtcgtggtagcggaagccgatcgcccggcccagcgagcggtcactgttgatcgcctgcttgagcatcttgagccgggcgtcgatgacctccggccgttccatgctcgcccactggaacggggtgtgcggcttgggcacgaacccgccgatcgacacggtgcagcggatgtccttggtgccggcggcctcgcggccggcccggatcacctcgtgcgccatgccggcgatctccaggacgtcctcgtcggtctcggtcggcaggccgcacatgaagtacagcttgacctgccgccagccgttcgaatacgccgtgacgacggtccggatcaggtcctccttggtcaccatcttgttgatgaccttgcggatccgctccgagccgccctcgggcgcgaaggtgagcccggtgcgccgcccgttacgggacagctcctgggccagatcgatgttgaacgcgtcgacccgggtggacggcagcgacagcgacacgttcgtgtccttgtactgctcggccaggccggagcacatgtcaccgatctcggtgtggtcggcgctggagagcgagagcaggcccacctcgctgtagccggagaactccagcccctccttgaccatctgggcgaccgtggtgatcgaccgctcccgcaccgggcgggtgatcatgccggcctggcagaaccggcagccccgggtgcaccctcggaagatctccaccgcgtaccgttcgtggaccgtctcggccagcgggaccagcggcttcttcgggtacggccaggcgtccaggtccatcgtcgtgcgcttggcgacccggaacgggacgtccggccggttcggcacgacgcgctggatgcggccgtcgggcagatagtcgacatcgtagaagcgcggcacgtagatgctctccgtgcgggccagacgcagcagcagctcgtcccggccacccgggcggccctcggccttccactcccggatgatcccggtgatctccaggaccgcctcctcgccgtcgccgagcacggcggcgtcgatgaagtcggcgatcggctccgggttgaacgcggcgtgcccgccggccagcaccaccgggtcgtcctcggtgcggtcggcgctgctgagcgggatgccggccagctccagggcgctgagcaggttggtgtatcccagctcggtggcgaacgagacgccgaacatgtcgaacgccttcaccgggcggtgcgcgtcgacggtgaactgcgggacgccgtgctccttcatcagcgcctcgaggtcgggccagaccgcgtaggtccgctcggccagcacgtccggctgctcgttgagcacctcgtagaggatctgcacgccctggttgggcaggccgacctcgtaggcgtccggatacatcagcgcccaccggacgacggtggcgtcccagtccttgacaacggcaccgagctcgccgcccacgtactggatcggtttgctgacccggggcagcagctgctcaagctgcgggaagacggaactcacgctcatgggtgtccagcgtacgcgagtggtcagccacccaattcgtcagcggcatggtccagatcgatcgcgaacaggtcgttgcggaacgcgcagagctgcagcgtcatccgggccgcgccgcgctcgccgaccaccaggcggatgggtttgccccgctcgtcgaggtcgccgacgatcaggtcgagcagtcgcaccccggcgctgtccaggaacgagaccgcggtcaggtcgatcagcacggcctcggccagggtggtgcgggccaccaccgcccggccgatgtcgtgcgcgttggccagatcgatctcaccccggaggtggacggtctcggccaccccgcgcttggagaaactcacccactggtcggtcatgcggcatccccccggtaccggcgcatggtcaccgtggtcccgccctcgccctgatcgaacagcatctcgtccatgcactcctcgatcagctgcaggccgcggccgcgggagtgcccgggtccgcgccaggtgccccggtcggcgacccggatctccaccgcgtcgtcggtgatcgtgacggacacctcgaccgtgccgaacgggtcgtcgcggtagccgtgctcgatcgcgttgccgaccgcctccgagcaggccagcagcaccgcgttcaggcactcccggtccaccccgtggctggccagccaggaccgcaggtcggagcggagcaggctgatctgcagcgggtcggcgccgagcgtgcgctccagccgctcctcgacgcccagggtcaggcagagcaggcagacgtcgtcgccgtgctcgcggccggccagggtgtcggtcagcgccatggtgagtcccttcatcggggctccgcgcagccggctgaactcccggttgagcacctcgaagccgtggtcgatcgggcggtcccggcgctcgatcagcccatcggtgtagagcagcaggcggctgcccggggccagccgtatccgggtctcggtgcggcgccggtcgccggcccgggtgccgatcgggccggagcgggcctgcagcaggaactcggccggaccggccggctggtgcagcagcggcggcaggtgcccggcgcaggcgtagaccagctcgcaggcgtccaggtcgatctcgccgtagacgacggtggccatccgggccgtctccacccgctgacagaaccggtccagtccctccagcagccgggccggcccgttctccgcggtggccagcgcccggatcgcgctgcgcagctggcccatcgtgctggccgcctccaggccccggccgaccacgtcgccgaccaccacggcgagcttgtgcggggtgatcaggaacgcgtcgaaccagtcgccgccgacctccagatcgtgcccggcggcccggtagtgggtctccagcgcgaaccgcgggtcaccggacggcacgtccgcggcgagcaggctgcgctgcagcgtccgggcgacggcccgctcctgctcgtagagccgggcgttctccagcgccaggccggcccggtcggccaggtcgatcaggaacgcctggtcggtctccggcgcgtgcctggtctcggccatccgcagcgcgagggtgccgagcacccggccccgcgcggtgagcggcagcacagcgcagtccagcgggtcaccctcggtggcgaagattggtttcaccgaccgggtcgcctccaggatccgcgcgcccagccgggcctcgtccggcgccgggccgccggcgtcctcgcgcagcccgaccggcccgacgtgcagccgcacggtggcccagtcggcgatcgccggcaccacccgctcgacgaggcggcggctgcgctgcatgagccggtgctcctcgtccagcgcccgggtggtgacggccaggaagtcggcccgctcctcgcggcgccgggcgtcgtcgtagagccgggcccggtccagcgcctgcccggcctgctgaccgagcagccggatcacccgcagctcgccgtcggacagccggcgctcctcggcgaagctgaacgccagcaggcccagcacggtcaccccggcgtggtcctcggccggaccggtggtcagcggcagcagcaccacggtgctgcggccggagcggaccatcgactcggccaggtccgggaagtgctcggccgcctcggccagggtgtgcaccacgtgcaggtcgccgcggcgggccacctcggccaccgcccgctgggacgagcgcggcatgtcgttccagttgccggtggtcgggtcggtggaggccaccgcgaccagctggtcgcggtcctggtcgaccaggtagatgctgctgctggtggcctggaaggcgccctccggcgcgcggaccaccgcctcggccacctccgcctcggtcggcgcggcggccaggtcggccactatccgctgcagcgccttgatccgctgctccgagctctccgccacgtcccgggcgagcagcagctcggtctcgtagctgcgccgctcggtcgcgttgaacaccatggtgcggatcacccggggtgccccgcccaccccgcgttcgagcaccgagttgaccagcacgggcacccgcgagccgtccgcgcacagcacgtcgagggcgatctcgtgcacctcgctctgcatggtgagcagcggagcgtagtgggtctcgtggtagatccggcaacccggagcgagcaggtcacggaaccgccggtgaccgatcagctcggcccgcgtgtacccggtccagctcaggaacgtctcgttgacccggaccacggtgccgtccgggagtgtcgtcagatagccgcagggtgcatgttcgtacaggtcctcgggatcgtcgtcccagggcagtcgtaactcctgtgtcacgtccggcccaccagattcactcacgccagtgctccgccgatcatgcccgctgtttacaaccaggacttgatcgcgtcaaccgtctcctgcggagcgctcacattcggacagtggccggtcgcgttcaacgcgatgagtgtgctgtgcggggtgtgcttgtggacgtactcgccgaccacggccggcgcgatcacgtcctcggagcactgcagcaccagcgagggcacccgcatccgggccaggtcggcccggttgtcggagaggaaggtgacccgggcgaacttcttggcgatcgccggatcggtgcggcagaacgagttggtcagctcctcgcccagctcgggacggtccgggttgcccatgatcaccggggccatcgcgctggaccagccgaggaagttgctgtccagcgagaccagcatctgctcgatgtcggtacgggtgaacccgccgacgtacccgtccgcctcgtcgtcgatgtatcgcggcgacgggccgaccatcaccaccccggcgaaccgctccggctcgcggaccgcggccagcaggccgatcatcgagctgaccgagtggcccacgaagatcacgtcgcgtagatcgtgctcgtggaggatgtccagcacgtccgaggcgtagccgtcgagcgtggagtacttctcgtcgtcgtacgcggtcaggtcggagcggccgttgccgacgtggtcgaagagcaccacccggtgcgtgtcggcgaaggccggggtgaccagccgccacatgttctggtcacagccgtagccgtgggcgaacagcatcggctgcccggactcccggccggagatcgtgacggcgttcctctgcgtgctgctcatccggtccgcgccctccccagagctctgtgatgtgggccgcatatcaggtccgggtaaccatacgactccgcagcgttccgcacatcgccctggttgtccgccattcgtgtccggtgcccggatcaagctccgctgcacgtctggcacaccgtccttaacctgggtgaaggcgcgtgccgccgccggcagaggaggagacggaaatccatggctgacaccaggccggacggcttttccgacgaaccgaccggcgtgctgccgccccggtggagcggcgccgcgccggtgccggtgcccgggccgcgccggtcgctgtgggaccggctggtcgaccgggtcggcggcgctcccgagccggaaccggagaactgggcgacgatgcccgccgtcgacccgtgggccggccaggacactccggcctggaccaccgagcacctggcgccgctcccggagatgccaccgacccgcctggaggccccggccgctccgatcggcacggccggtccgggtgtcccggccgtgccgaccggcatcgtcgatcggggtgccccggccgttccgaccggcatcgtcggtcagggtgccccggccgttccgaccggcatcgtcggtcagggtgccccggccggcaagcaggagaagatcaaggcgctactggacgcgctggcggccaaggcggccgagaccgcggaggcccgcaacgccaaaccggcccgcggcggcccggctcacgacgtacccctcaaccgaccgcaagcggccgcgaaaccgccgtcgcgcggctggttccgcaagccgccgcccagcgccgcgccgccgcgcctgccggagaaaccccgcccgcggcgccggctacgccggctgcgacggctcgccctggtcctcgccgtcctggccgcggcctggttcgcagcccctctcgcgtacgagcggtggccggtcctggcgcagttcccggtctccgcggcgcttcccgaccgggtcggtgacctgcgcctgcgcgccgacccggcgagcacgaaagccgtcgaccgcctcgccgaccagctgcggtcggcgggcgtcgacggcagcgcgttcgccggcgtctacggcgacggcaacggcaaacgggtcaccgtgtacggcgtcaccggctggcgtttcaccccgcagtccgacgccctcggccagctggcccggatcgccggcgacgccgagctcagcgacgtcgcggactacccgctggacgaaccgggcgccttcgagagctgcggcaccgggcggctgggcggcacgtcgacggtgatctgcacctgggcggaccacggcagcatggcgaccgtgctgctcacccgacggtcgccggaggagagcgccgccctggtggcccggctgcgcggggcggtgctcagcccgaagttcggggcgtgagcgtcactcctcgcgcttcggcgcgtaccgcggcacgtactcctggccggtgagtttctggatctcgcccatcacctggtcggtgagctcgcgcagcgaggtgcggtcactggagcggccgatcgtctcgatcggcttgccgaacttgaccgtgacggtgccgcgcatcagtttcggcgcgagccggccgatcggctgcaccacatcggtgccgatcatgccgaccgggatgatcggcacgccggccgcggtggccagccgggccacgccggtgcgtccgcggtagagcttgccgtccggcgagcgggtgccctccgggtagaccgcgaccagatcgccgcccttgagcgcggggatggcggcgtcgaaggcggtgagcgcggcccgcccaccggcccgctcgacccggatcgcgccgagtccctccatcagcttccgcgagaggaaacccttcacccctttaccgacgaagtagtcggacttggcccagaacgccaggtggcgcgggaccgcggcgccgaggaagagctcgtcggcgaccgagaggtggttgccggcgaagatcgcgccgccggtcttcgggatgtgctcgaggccctcgatgcgcggcttccaacccaccatcagcgtgttgccgacagtgagcttgccgatcgtgtagatcaggggcaactcgtcctccggaagaccagtgcaaaaagacgtcgaggggtgaggagaggttatcggacgcggggccgctgtggactattgatcttgcggctggcccggacattcgccgcgccaagcgaacatccgggccagtcggttatgtcacaccgcggtcacaccgacggtgatctgctcgccgtcgccgacttcgccgtcgaacccctcgacgccgtcgaaggtcagcgaggtggccaaggtctcaccggcgacgaactcccggtgcgtctccaccgccgcccgcaccgccgcggaggccgacacgatcagcgagatccggtccgagacgtccaggccggcgtcccggcgggcctgctgcaccacccggatcacgtcccgggccagaccctcggcggccagctccggagtgaccgcggcatccagcaccacgacgccgccaccggccggcagcggggcggagttctccgcgtccgcggcgaccagcttcagctcgtactccccctcggccagggtgatcccggcggccaccggggcgccgtcgatcagctcccagtcaccggccttgaccgccttgatcacctgctggacctgcttgccgacccgcgggccgagcgcccgggggacgaccgtgaggacctgctggcagtacgccgcgacgtcgtcggtgaagaccacgtccttgacgttgacctcgtccttgagcaggtcgccgagcgactccagcgaccggccgtgcgcggcggcgacggtgagcgtggccagcggcaggcgcacccgcagggccttggccttgcgcagcgacagggcggccgacgcgacgtcgcggatcgcgtccatcgaggcgaccagctcgtggtcggccgggaacgcgtcggcggacggccagtcggtgaggtggaccgaacggccgccggtcaggccgcgccagacctcctccgcggtgagcggagcgagcggcgccaccacccggcagagcgcctccaggacggtggccagggtgtcgaacgcgtcggcgtcacccgcccagaaccggtcccgggaccggcggacgtaccagttggtcagcgcgtccaggtaggagcggacacccgccgccgcaccagagatgtcgtattcgtccatctttttcgcgacatcttccaccagctcgccggtcttggcgaggatgtagcgatcgagaaggtgggtggaatcggtccgaaatttcgcctcatgggacgcggcgttcgcataaaggctgaagaagtaccagacgttccagagcggcaggagcacctggcggaccgagtcgcggatcgccgtctcggtgaccggcatgtccccgccccgcagcaccggcgacgacatcagcatccagcgcatggcatccgacccgtacgagtcgaacacccggtacacgtccgggtagttgcgcagggacttggacatcttgcgcccgtcctcgcccagcaggatgccgtggctcaggcagttccggaacgccggccggtcgaacagcgcggtcgccagcacgtgcatggtgtagaaccagccccgcgtctgcccgatgtactccacgatgaagtcacccgggtagtggtgctcgaaccactccttgttctcgaacgggtagtgcacctgcgcgaacggcatcgaccccgactcgaaccagcagtccagcacctccggcacccggcgcatggtggatctcccggtcgggtcgtccgggttcggccgggtcagctcgtccacaccgggccggtgcaggtcggtgaccgccaccccgaagtcgcgggagagctcctcgaaggacccgtagacgtccacccgcggatactgcggatcgtccgacttccagaccgggatcggcgagccccagaaccggttccgggagatcgaccagtcccgcgcgttcgacagccacttgccgaacgagccgtccttgatgtgcgccggcgtccaggtgatctcctggttcagctcgaccatccggtcccggaacctggtcaccgccacgaaccaggacgacaccgccttgtagaccagcggggtgtcgcagcgccagcagtgcgggtacgagtgggtgtagccgtcgtgccggaccaccacgccgcgctccttgagcgtggcgatcaccggcttgttcgcgtcgaagacctgcaggccctggaagtcgggtaccagcgaggtgaaccgggtctgctcgtcgacggtgaccacggtcgggatgccggccgcgaggcaggcgttctggtcgtcctcgccgaacgcgggcgccatgtgcaccacgccggtgccgtcctcggtggtcacgaagtcggcgccgagcacctggaaggcgttctccccggccggctccaccaggtagtcgaacagcggcgtgtagcggcgcccgacgagctcgctgccccgcaccgtgccgacctgctcgtagccgtcgagctccttggcgtaggcggccacccgcccggcaccgacgatgagcttctgccccgcgccgtcggcgaggaccgcgtactcgatgtccggtccgaccgcgagcgccaggttcgacggcagcgtccacggcgtggtcgtccagaccgcgatgtcctcaccggtcgacagccggaacttcaccgtcagtgcggggtcggtccggtcccggtagacgtcgtccatccgcgtctcggtgttggagagcggcgtctcgcaccggtagcaataggcgagaacccggaaaccctcgtacaccaggcctttgtcgtgcagggtcttgaacgcccacatgaccgactccatgtaatcggggtcgagggtcttgtagtcgttcccgaaatccacccaccgcgcttggcgggtgacatatccctgccagtccttggtgtaggcgagcacggacgtgcggcaggcctcgttgaacttgtcgataccgagttcgacgatctgcgccttgctggtgatgccgagctgtttctccgcctcgatctcggccggcatgccgtgggtgtcccagccgaatcggcgttccacccgctggccgcgcatcgtccggtaacgcggcaccacgtccttgacgtaaccggtgaaaaggtggccgtaatgcggcagtccattcgcgaacggcgggccgtcgtagaagacgtactcgttcgcgccgttctccccggccggacgctgctcgaccgaggcctcgaaggtcttgtcggccgcccagtgctccaggaccgcgcgctcgaccgcgggcaggtccggggaggccggaacgccctgcgcatcggtgtgcttcggatacatcgtgctcctcaaacagtcatcgcctgactgcgaggacgagcggaattgccgcccgcggtaccacctcgcttggcctcccaccggggaaacccgctcattcgccggctgtggcgcgtgccgatccgcccggttctactcgcgctggaggcgctttcttccggaggctccccggtgatggccggttcgtcgcctgcgtgcgcacaacgataccggccaccccgggattccctcacccaggttctttctcagaagaacaagacgattgcggggtacgccgtgagcacggccgtcatccgcccgatcgccggtggccccgaggtgaccgtgcccggaccagccgggccggtcccctttgccgatcctcttctgatcagcagcggtcagggccgtagatcacaggtgcgggaaccagagcgccagctcacgcttggcactgtccggcgagtcggaggcgtgcaccaggttctcccggttggagagggccaggtcgccgcggatcgtgccggccgcggccttgcgcccgtcggtcgcgccgatcatggcgcgcaccacctcgatcacctcgtcgccggagagcaccacggcggccagcgggccgctggtcatgaaatccttcagcggcgggtagaacgccttgtcgacgtgctcggcgtagtgctggtcggcgagctcggggctcatcgtgcgcacctccagcgcctcgatgaccaggcccttacgctcgaaccgggacaggatctcgccgagcagaccgcggcggaccgcgtcaggcttgatgaggatgagcgaacgctcggtgctggtggacacgtagttcctctcgaagacgtcaggccgacacgcctgaggttcagcctatcggtacctccgacacggcgagcgacgatgtccgtactaccgcactttcgctcttcgaccggcgggccataacctgacctgaacaacgggaggtccacagtggcgaaccagaccgggcggcccatcgccccggcacgcaagttggtggcggcggtcatgggcacgctcgcgggctttgtgatcgtttacgggctcggcatgaagagctggcccgtctcgatcttcgggctggtcgtgctggccatcgcggtcacgctcgccgtggtcacccccggccgccgcggtggccgggccaccgtcgccggcaccgcggagatcatggacatcaccgcgccaccgctcgccggggcgtacggccgggccgagatccgggccatcgtcgtcgcccccggcctgggcaccttcgacaaggtgatccgggacggccgggtgccggtcgcgaaatggccggtcgccggctccaccgtgccgatcaccgtcgacgtcgacgacacccgccgggtccgggtcaactggaaggacgccccggacctcggcccggccggcgacccgccgccgccggtcaccggctccgcccactccgagttccacgaggacccgctgctccccgaggaggaggacgacgacgtgctcggcgcggtcgcccccaagccgtgggagacccgcgacgacgactgggccgcccaggagccggcgtacgaggaggagcgcgccaccaccccggtggtggtccgggacaccccgaacgggccgatcctcgaggggcagctggtcggcggcgaagaacaggtcgcgccgctgccccgccgcgccggcagcggcccgcgtcgctcggggggctccttcgactccgccgccaccgacccggtcggcttcgatccgctccccacggatccggccacgcccgacgaccccgccaatggggaggatccggccacccgggaagacccggccgcgcctgcgagcccggccgctcctacgggcccggtcgctcctacaggcccggccgcccccgcgagcccggccgccctggaggacccggccgtccctgcgggcccggcggcccctgcgagcccggctgccccccacaggcccggcgccatccgccgccgcgtcgtcgaccgctgtcgccgaggaatcgccggtcttcgccaccgaggcggagccggcggccgccgcgaccgtcccgcggccctcttcggcaacggcatccgtcccgttcgcgtccgccgccgaagtggacccggaccggatcgccgccggcagcgcctccagccggttcgggtcgggcgcctcctccgaggcctggccgtcggccagctacccgcccccgcccggacccgaggccgccggccgccggcccggcggcgacgactcgttcgacttcccgcccccgcccccgccgggcgccaccccggccggtgaacctgacgagttcccgcccccgccgtccccgggctccgcccgttccgtcaaccagtccgacgactacgactacccgccgccccccgccccgggccggacccggcgggcccccacgacccccaccggtgccgactatccacccccacccggccccgccacctcctccaccggcgccaccacctacacctcttccgccggcgccggccccaccactcccgataccttcgcgtcgcccgccggcgccggccccaccactcccgataccttcgcgtcgcccgccggcgccggcccctccgcccgcgatgccttcgcgtcgcccgccggcacgagtccctctcccagcgcgccgcagcagtcctcgggcgacgccccccgctactcgggcttgagcgagtccggtcccgcgcccgggagcggcccctctgccgccgcattcgccgcgggcgtagccaccggcgccgccagctccgccatccgcaccacgaccccgcgcccacccggctcccgccccagcccgaagccgcgttcggcgtccgccaccgtcaccgcgaaccgcacacccacccagcgcaccccggtcgaccccaccccggaaccggcgatcgacctggacctggacgagccgccggctcccccggctccgccggcccccacccagcgcccggtggccccgccggccgagcccaagccgaccactgccaccgccgcggtcccgcaccagccgaccaccgctaccaccgcggtcccgcaccagccgaccaccgctagcaccgcggtcccgcaccagccgaccaccgctaccaccgcggtcccgcaccagccgacccccaccacggagccgacctccaagcccgagcccaagtccacccattccggtcggacccgcttcgtcacccagccgggcgaccccgccgcccccaccccgggcaccgccgcatcccccatcccgatgcccgccgccccgcccccgagcgacgccatcagggcgccggtcgccccgcccccgagcgacgccgcccgggcgccggccgccccaccgggctagctagctagggggccgccgcagtcccgatgccggccacccccaccggggccgctgccatcccggtgcacaccgcttcaggtccggcagccgggaccgactccgacgacccgggcctcgacggttacccgccggccgccttcccggtcagcgcctacgcacccaccgacccggagcccccggttccgcccgcgccggtgtccaccgcccgggccgagccgaccccgctcaccgccccgccgaccgccccggagccggaccgacccttcccgaccgcgccaccaccggcgaccccgcgccccgccgcccccaccccggtcgccgacgagatcgacatcccgctggacgacgtcccggagtccacccccgaagccgccccggcggtcgccgccggcatcgtcgctcccccggcggaccccggcgacatcgtcaccccctggacagaccccggcgacatcgccaccccttgggcggaccccgccgacatcgtcacttccccggcggccgaacccccggcggagcagtcagccgccgctttccccgccaccgccgagccggacgatgcgcccagcgccgagaccaccgcctggccggtcaccgccgactcccccaccgccgcagccggcgcggagggccggaagggcaacccctgggctgatttcgccggccggccggtgcccgacgaccgcaccgccgaggtgatcaccgcctatcccagtgcccgccccggcccggccggcgcaatccacggcgtgggcatcaccatcctggtcaccgacctggcccggtcgatcgtcttctaccgggacacgctcggcttcttcgagatcgacaccggtgacggcagttcggtgctggcttccggcgacacccgggtggtcctgcgtaccgtcccgaacctgtccgccgaggcgggccgcctgatctatctgaacctggaggtcggcgacatcgaggcggttcacgacgagctccgggccaagggcgtcaagttcgtccactccccccgggccgtcaaccgcggcgacaagctggagctctggtccgcgaccttccgtgacccggacaaccacaacatcgcgatcacccagtggcgagccgtccgcccggatcccacccccgaggcctgacgtttcccggaaagcatgatggggagtcaccgcatggcgactccccatcatgcgtctcagccggcgcccgttctcacccgaggatcgaccgccgcacgtacgtcgcgtaggcccaggccagcccgaagatcaccccgagcgcggcgagcgaccagtgcaccagcccgctggcgagcagcagcacctgcagcgccgtccccgcgccccacccccaccgctgccgcatgcatccggcgagcagcgcggccaccacggcgagcccgatgaccaggccgatcccccacccgctgaggtgcccaccgaggatccggatcggctggatggccagcagcaggacgatcgcttcgagggccagggtgcccgctccgagaccgcgtaccgccgcttcggggttgcgcagcccggaacgccgcggcccagcgcccgcctcgtccccgaccggcgccgcgttctcctccggcccggtcatcgtttgagcagtttccgcgcgtcggcgacggtgaccaccgacccggtgatcagcacgccgacgccgctcagttcgccggacgcgtcctcctcggccagcaccacggcttcctcgatggcgtccggcatggtttcggcgatgctcacccggtcctcaccgaacacgttggcggcgagctgcgcgagttcctgcaccggcatcgaccgcggtgagctgttctgtgtcaccacgatccgcgccaccacgggttcgagcaggtcgagcagcccggtcacgtccttgtcggcgaagacggcgagcaccgccaccaggtgccggaagctgaactcctcctccagcgccgcgacggtggccgccatcccgtgcgggttgtgcgcgccgtccagcaggatggccggtgcgctgcgcacccgttccagccgcccgggcgagtccacctgggcgaatccttcgcggatcagctcgatgtcgatctgcttgcccggcccggcgccgaggaacgcctcgaccgcggccagcgccagcgccgcgttctgcgcctggtgcgcgccgaacagcggcaggaagatctcctcgtacaccccgccgaggccctgcagcacgaggacctggccgccgaccgcctgggtacgctgcaccacgccgaactcactgccctcgcgggccagcgtggcgcccatctccgcgcagcgttccaggatcggccgcatggcctcctcggtctgcaccgcggtgatcacggtcgcgtccttgtggatgatcccggctttggcccaggcgatgtcctcgatcgtgtcgccgagccactcggtgtggtcgagcccgatcggggtgagcacgcacaccccggcatcgatcacgttggtggcgtcctcttcgccgccgagccccacctcgacgaccgcgatgtcgaccggcgcgtcggcgaacgccgcgtacgccatggccgtggtcatgtcgaagtaggtgagcggctcgctgttgcgcgcgtcgatcagctcggcgagcggggcgatctcccggtacgtgtcgaccagccgctcctcggacaccggctcaccgtcgaggctgatccgctcccgcaccgtttccaggtgcgggctggtgtagcgcccggtgtgcagcccgcaggcccgcagcagcccgtcgatcatccgcgccgtgctggtcttgccgttggtgccggtcaggtggatcgccgggtaggcccgctgcgggctgcccagcacgtccatcagatcccggatcttctgcatgtcgaagaccatccgggtgaagccgcgctcgttcagcgcggcctcgaccgccgcgtatgcggaggcgtgctcggaggagtgctcggcgggactcatgcggccggcagcgcctcgagcgcggtggcgatccggaccaggtcggcctcagcggtggccagcctgtccttgatcttggccacgacggcctccggcgccttgccgatgaacgcctcgttgcccagtttcgccctgcactgcgcggcctccttctcggcagccgcccggtccttgtccagccgggcacgctcggcggccacgtcgatcgccccgcgggtgtccaggtcgacggtgatcccaccggtgaccgccagggtggcggtcgcggtgaagccgtcggccggcgcgtccagccgggccagcgagcggatcagcggctcgtgcgtgtcgatgccgacgttgcccagcccggtcagcgccgcggaaacccgctggctcggcttgagcccctggtcggaccggaaccgtcggacctcggtgaccaccttctgcagggcggccagctcctcctcggcggcgtcgtcgaccagcgcgtggtcgaccatcggccaggtcgcgaaggtgaccgtctcgcggccggtgagcgcgatccacagctcctcggtgacgaacgggatcaccgggtgcagcaggcgcagcagctggtcgagcacgtgcccgagaacccgccggctgcgtgccgcctccggggtgtcctgggccagcaccggcttgctcagctcgacgtaccagtcgcagacgtcgtcccacgcgaagtggtacagcgtgtcgcagaccttcgcgtactcgtagctgtcgaactgctcgttgacctcggcgatggtgtgctgcagccgggacaggatccacttgtcgatcgcgctgagctcgctgggcgcgggcaggtcgccctcgacggtggcgccgttcatcatcgcgaaccgggtcgcgttccacagcttgttgcagaagttgcgggagccctgacaccactcctcgctggtcgccacgtcggagcccgggttggcgccccgcatcagggtgaaccgggtggcgtccgcgccgtaccggtcgatccagtccagcgggtccaccacgttgccgaacgacttcgacatcttcttgccgaactggtcgcggacgatgccgtgcaggttcaccacgttgaacggctgcacgccgtccatcgcgtagagcccgaacatcatcatccgggcgacccagaagaacaggatgtcgtagccggtgaccaggacgctggtcggatagaacttcgccagctccggcgtacgctccggccagcccagggtcgagaacggccacagcccggacgagaaccaggtgtccagcacatcggtgtcctgggtccagccctcgccggtgggcggctgctcgtccggcccgacgcagacgacctcgccggccgggccgtaccacaccgggatgcggtgaccccaccacagctggcgcgagatgcaccagtcgtgcatgttgtcgacccaggcgaagtaccgcttcgacagctcctccggctcgatccggacccggccgtcgcggacggcgtcaccggccgctttggccagcggcgtggtgttgacgaaccactgcagcgacagccgcggctcgacggtcgtcttgcaccgcgagcagtgcccgacggagtgctcgtacggccgcttctcggcgacgatccggccctgctcgcgcagcgcggcgacgaccgccggacgggcctcgtaccggtccaggccctcgaacggaccgggcacggtgatcaccgcgcgctcgtccatcacggtgaggctgggcaggccgtgccgctgcccgatctcgaagtcgttcgggtcgtgcgccggggtcaccttgaccgcaccggtgccgaacgccgggtcgacgtgctcgtcggccacgatcgggatgcgccggccggtcagcggcagctcgacctcggtgccgaccaggtgccggtaccgctcgtcgtcggggtgcaccgccaccgcggtgtcaccgagcatcgtctcggcccgggtggtggcgaccacgatcgcgttcgcgccctcgccgtaccggatggagaccagctcaccctcgtcgttggtgtgctccacctcgatgtcgctcagggcggtcagacaccgcgggcaccagttgatgatccggttcgcgcggtagatcagatcgtcgtcgtacagccgcttgaagatcgtttgaacggcccgggagaggccctcgtccatggtgaagcgctcccgggaccagtcgaccgagtcacccagccggcgcatctgccccaggatcgcgccgccggactcggccttccactcccagaccttggcgacgaaggcctcgcggcccaggtcgtgccgggacagctgccgctcggccagcttgcgctcgaccacgttctgcgtggcgatgccggcgtggtccatcccgggcagccagagcacctcgaagccctgcatgcgcttgaggcgcaccagggtgtcctggatggtgtggtcgagggcgtggccgacgtgcagcgagccggtcacgttcggcggcgggatgacgatggtgaacggcggcttgtcgctcttcgggtcggcggtgaagtagccctccgatacccaccgctcgtaccgccgctgctctacctcgcccggctggtactgagcggagaggccaccggtgggccggctgtcgggagtgcgggtatcggtcgtgtcggtcacagggcaagtctacggattcccggaggcggtcaactattcgcactcccacctgtggataactgtaggctcgcctgatgtccgaccgcggccacgcgccccctccgcccgccggcgacgcccccgaaccggatcccgcggagcccgatttgtcgcgggacatcgagatcagcgcggttccggccgcggccgggcccgagccggccgataccgacgcggagcctttggacctcaccgaaggcgagccgatcgagctccaggccggcccgttcagcctggtgccggtcgaggacggcgacgatgcgccgttgagcccgcgccgccggcgcacccgcaccatcctgaccggctcgctgctggcggtcggcctgctcggcgtcgccggcctcggctggtactactggcagatccacgtccagcgcgacgtcacgctcagcctgccgccgtcggtcgccgacatgacgctggacgacagcccgaacgccaaggacaccgccgactatctgcagaccgcgctgaacaccgagatcgacatggacaagaccgtcggcggcgtctacagcggcaccggcgagaaggacgtgctgatcttcggcggcaccacgctgatctggagccccggcaaggatctggctacgtcgttcggcttgatcagcgacaagcagggcaccgtcaccggcctgcacgacgtcgacccgggcccgctcggcggctcgatgaagtgcggaatcaccaggaccgagggcggcaacatgccggtctgcgggtgggccgaccacggttcgctggccctcgccatgttcccgaaccgttccgaatccgaagccgctcccttgatgctgcaactccgaaaagccattcaaacccgcaattgacagtacgtcgaaaagcgcctcggctagctagctagtcgaaacccgatctccgtccggagaaccgcttccgaggcaaccgttcaagcttacctggtcgttttcgctcggcgaaatccggggatctcgctggcctcgcccaagtgttttccacgaatgtggaagtggctcatgcagaccggccgactcgaacgtccgcccggctcctgctggctgatccactatacccggtcggtctcgctggcgcaacctcgaggtttcgagatcctgccgcaccgcccggcgctgaaaacaagactagctcgctgcagcggccctcgaggtggcgatccggattgtcactttcgtgcctgtccgtaccgctttcccgctggcagagaagaaattacttgaccgcccgtccgtcgcgcaaatcgatgaacatggtcatcagcggccgcgcggcgtacacccgggccggaaaccgtgacagagtgacctcatgaacccatccgaggcgtcggcgagcgacgggttactggacctgatcgtgccgctctggcagctcgtgatcggcgtgctcgtgctggtgaccgtggtcgtctcgacccggaaactgctgctgcgcggcccctcccggatgagcggcgcactcctgctggtcggctcggcggtggtcggcctcgccgtcatcagctacctgttgcagaccctgtgaccgcgcccacccgccgctagtggccgtttccgttcagagccggcggttggccaggctcggcaactcctcgcggatggtgtccagccggcccaggtccagatccgccgtcgcgatccccaccccgtcggccacctgcgccaggactgtcccccacgggtcgatgatcatgctgcggccgaagcaggtccgtcccggctcgtggtcgccgatctggccggccgccacgacgtagcactggttctcgatcgcccgggcgcgcagcagcacctcccagtggtcgcgcccggtgtgcagcatgaacgccgcgggaaccaccaggatcttcgccccggcgatcgcgagctgccggtacagctcagggaaccgcaggtcgtaacagatgctcagcccagtcggcacgctgccgatcgccgcgaccacggtttccgcgcccggcgcgacggtgcgggactcctggtaggacacccgacccgcgatctccacgtcgtacaggtgaatcttgcgataggtcgccgcgagggaaccgtcgggccggaagaccagcgtggtgttgaaggtccgctgctcatcggggccggtctcgtggaacgagccggcgtgcacccagatgtccagctcgcgcgcggcggtggcgaagaacgcggcgaactcgccgtcgaccggctccggcgggggcgcgtccttggcccggccgaggaagtcgacatattccggcaggacggcaagctcggcgccgccggcggcggcgcgctccaggaggcctcgcgcgacgtcgagattgtgggcgcggtcttcccgcgagttcagctggcacacggcgacgcgcatgaattcgagcgtacgtcgtcagcccccggtcaccagccggcggtgggtggcatcagcaggatttccgagccgaccggctgaaatccggcggcgagcaggacgcgcaggctcgcggcgttccccggggcgcactgggcccagatcggccggtcctgcgggatcaggtggcgggccgccgcggccaggagccggccgtggccgcgcccgcgcgctgccgggtcgacctcgaacgccacctcccagcggccgcccagaccacggccgacgaccagcagaccgtgctgggacgtccagagccgcacgtcggtgcggtaccggtgggcgcggagggcccgcgggtgtccgctggcgttcagcggcgtgagcggcagcggcggatcaccggcgaggggggtggcgagcagggagacgtcgaaggcgccggcgtgcaggccgaaccggtcctccagggcggtcaggaaccgcggcccggtgggggcggcgaaatcctcgccggcgagcttctcggcccagaccggctcgaccgcggccgcgacgacgacgtgacccgggaacgacaccaccgccgcccgatcggacgacggcggtggcacgatctcgagccacgggtccggcacgtgccggtcgccgctctcgacaccggcgaggatgctcgccaggtcgcggattccggtcaggcggatttctcctcacgggcgtggcgacggcggccgacgaactcgcggggcacgatcgtcgggttcacgttctccaggaccacctcgcgggtgatcagtacgcgggcggcgtccgggttgctgggcacctcgtacatcacggagaggagcacctcctccatgatcgcgcggaggccgcgagcgccggtgccgcggagcatcgcctggtcggcgatcgcttctagggcgccctcgtcgaactccagctcgacgccgtccagctcgaagaggcgctggtactgcttcacgtaggcgttccgcggctcggtgaggatcttgatgagcgcttcccggtccaggttgcggaccgtggtgatcaccgggagacggccgatgaactcggggatcagcccgaatttcagcatgtcctccggcatcaccttgctgaagatgtcgtcggtgttgcgctccgagatcgaccgcagccgggcgccgaatccgaccccgccctggccgacgcgctgctcgatgatccggtccaggccggcgaacgcgccgcccacgatgaacagcacgttcgtcgtgtcgatctggatgaactcctggtgcgggtgcttgcggccgccctgcggcggaacgttcgccaccgtgccctcgaggatcttcagcagggcctgctgcacgccctcgccggagacgtcccgggtgatcgacgggttctcgctcttgcgggcgatcttgtcgacctcgtcgatgtagatgatgccctgctcggcgcgcttgacgtcgtagtcggccgcctggatcagcttgagcaggatgttctcgacgtcctcgccgacatagccggcctcggtgagcgccgtggcgtccgcgatcgcgaacggcacgttcagcatccgggccagggtctgcgcgaggtgcgtcttaccgcagccggtggggccgatgagcatgatgttggacttggccacctcgacgtcgctgctcccgccgggagcgccgttcgactcggcctggatccgcttgtagtggttgtagaccgcgacggcgagagctttcttcgcctgttcctggccgaccacgtagttgtccaggaactggcagatctccatcggcttgggaagctcttcccacttcacctcgccggtctcggccagttcctcctcgatgatctcgttacagagatcgatgcactcgtcgcagatgtagaccccagggcccgcgatgagcttcttgacctgcttctgcgatttaccgcagaaggagcatttgagtaggtcgccaccgtcaccgatccgtgccacctacgttctccttgcgctcaacgactgaccactggccggtccgtgtccgaggacggattgcctcgttgccatctcatcgtctgccgacccgcgtaactgaggatgctggctcgacgttacccgcaaaggggctgttctccgaccccccaaaacgggcgtgtcagggaccggccagtctagcgtgaccggtccggcccctgacgtcacgtgtctcagctgctcgcgccgaccgtctgcaggctcttcttgcgggtcgcgagcaccacgtcgaccaggccgtactccttggcctcagccgccgtcatgatcttatcccggtcgatgtccttacggaccttctcgatcgactgacccgaatgctgggagatcatgtcctccagctgggtccgcatccgcatgatctcgcgcgcctggatctcgatgtccgaaccctggccgtaaccaccctcggtggccggctggtggatgatgatccgcgagtgcggcagcgccatccgcttacccggggtgccaccggcgagcagcaccgcggccgcactggccgcctggcccaggcagaccgtgctgatgtcgggccgcacgtactgcatggtgtcgtagatcgcggtcatcgcggtgaacgagccacccggggagttgatgtacatcaggatgtcgcggtccgggtcggtgctctccagcgtcagcagctgggccatcacgtcgttcgccgacgcgtcgtccacctggacgccgaggaagatgatccggtcctcgaacatcttgttgtacgggttcgactccttgagaccgtacgaggtgcgctcggtgaacgagggcagcacgtagcggttgtgcaccggagcgaacccgggaggcatggaaaggtcggtcatggttcagctcctcagttcagcgttccggcaccgtccgggacctggacggccccggtgatcaccttgtcgatgaagccatagtcctgcgcctcggcggccgtgaaccagcggtcccggtcgaagtcggcggcgatctgctcctgggtctggcccgtgtggaacgcgatccgctcctggaacatgcgcttggtgtacagcatctgctccgcctggatggcgatgtcggcggcggtgccacccataccaccggacggctggtgcatcatgatgcgggcgtggggcagggcgtaccgcttgccgggggtgccggcgcagagcaggaactgccccatcgaggcggccatgcccatcccgacggtcgacacgtcgttgtcgatgaactgcatcgtgtcgtagatggccatacccgagtagacagagccgcccggcgagttgatccagaggtggatgtcccgctccgggtcctcggcggagagcagcaggagctgcgcgcagatgcggttggcgaccgcgtcggtcacctcgctgccgaggaagatgatccgctcacgcagcaggcggttgaagaccgagtcgtcgaggttgccactcagggagtcgccgccgcgccgcgacacgggcccggcagggatgtggagttcggtcatggcagcccttcacagcttgctgtgtcggccgaggctccggccggcaggttgtccgtcgtacgaccaacctaaccggtcgattgcgcatcagcttcccgctcgggcaggtgttcgctgacagcgcaccggcccccgtacgtacccctgaaacggcagtggccaccgcggaccgtgagcggtgcgcggtggccgtctgcgactgcctggatcagtggttgtgaccggcgtgctcgtcctcgctggcggcgcgcaggtcgtccagcgtgagcgtgttgccctcgctgtccttcatcgtgacctgctccatcaccgaggcgagggccttgccccggcgcacgtcgccgaagacggccgccgcggcgcccgaccggaccagctggtcgtagtactgctgaggctgcatctgggcgcgctgcgcccggtgcacgatctcgtgaccgaactcgtcgtcggtgacctggacgtcctcggcgtcggcgacggtgtcgagcagcagctggatccggacgccctcctgggccgcctcggtcagctcctggtcgatctgctcctcggtcttctcctcggaggcgaggtagtcggccagggtggcgccgatccgctccagctggtcggtcatggcctgcttgcggccctcgacctcgtccttgacgacaccctccggggccggaatgttcgcggcctcgacgagctgcttgagagcctcgtcacgggcggcgtagatctgctcgaccttcttcaccttggtgagccgctcgcgcaggtcgccgcgcagctcctcgagagtgtcgaactcgctcgccagctgcgcgaagtcgtcgtcgatctcgggcagctgcttgtccttgacggtgcgcacgacgaccttcacgtcagcgtcacggccggcgaagtcgccgccgaccagctgggtggtgaaggtggtctcgtcgccggcggacaggccgaccagcacctcgtccagacccgggagcagctgcttgctgcccacctcgtgggagatgttggtggccgagccgcccggcacctcctcgccgtcgacggtcgcgttcaggtcgagctggacgtagtcgccctccgcagcggcccgctccaccgtcttcagcgtggcgaaacgctcccgcaggccgttgatctgctcgtcgatctcgttgtcgccgatctcgacggccggcacctcgacgctgatcgtcgacaggtccggaaccacgatctccggccgcacgtccacctcggcggtgaacttcagcggcgcgttgtcggcgaactcggtgatctccacctcagggcggccgagcgtcttgacgtcgtgctcctggaccgcggcgaggatctgctgcgggatcgcctcctggacggcctcgttcagcacagcgccccggccgacgcgctggtcgatcaccgcggacggcaccttgccctttcggaagcccggcacctgaacctgcgcgccgatctcccggtacgccttctgcaggctcggcttgagctcgtcgaacggcacctcgatggcgagcttcacccgggtcgggctcagagtctcgacggtgctcttcacaggcgtactccttgttgctgcggatagttagtaatcagtcggggtggcgggatttgaacccacggcccctcgctcccaaagcgagtgcgctaccaagctgcgccacaccccgtggcgtcggccagtgtatgcggtctgctcacccgcgtgtgcgctggagtcacctgctggggaatccggttcgcgcggacggcagatgattcagtaagctgtgcccgagacccggagcgatccggggcctcgcgggcgtagctcaatggtagagcctcagtcttccaaactgattacgcgagttcgattctcgtcgcccgctccgcaacggaggcccaggtcaggggttgtccctccgaccagggccttcgtcgttcacccgcccggatgatcttgtaggccaccacccgggcgcgacgcggcggagcgagtacgggtcctcctcgccgcagtccgcgcggcgccacgtgccgatcgagccgagcttgcgcgaagtccgatggctcacggaccccagcggacaagaagccgctcattggtcgcgctccctattgcggtcacggcacggctccttaaagatcgacggccgccgcccgcctccgggaacggacaccgggggcggtgcggcaggttcggcacagatcgtgagtcaggtgagtagggagatcacgcagcgagctgcggaccgcagcaggatgcggatgggaacccgcacaagggtgctgctccggtgccgataccttccaagcgtgaccagccccaacgaaccgcccgacgtctcccgcccgcaggtcgccgccggcgtcctgttcttcgacgaggcaggatgcgtgctcctcgtccagccgagttacaagaccgggtgggagataccgggcggatacgttgaagccggcgaatcaccgaaggctgcctgtattcgtgaagtcgccgaggagctggggctctcgccggccatcggtgaccacctgatcgtcgactgggcacccgctacaggcgagggtgacaagctcctgttcatcttcgacggcggcatccttcccgagagagatcgagcccggatcgacttcgtcgacggcgagctggccgattggcgattcgtggccatcaccgatcttgagacgtacgtaccggctcgcctggcacgtcgaatcacgaccgcggccgcagcccggcaaggggcacgtcccgtctacgccgagcatggcgtcgcgaaatagcgctcctcgcagccccaccaactgcaccgtgtcctggacggatcgcttggcgatctccttgccgagccgtcgctggtcgagtaaaccgcggacagcggatgggagacagcgccatggatcaaggcgccgcgcgagcgcggcacggtcggaccgcgcggccggcgggccggccaacgtgaaatctcgttcgaggcggctcacgatcgctgcgggtggggcgccatacgcccggcgatcagctgccgcgccacttcgcggtttgccaccggcaacggtgccgatgccggggcggcgagacgagtacgcgtggtgcggcgaagcgggcggcttgaggttgaatgtccagttccgccgtagccgcgagaatggccgccgcggcgagagagcgttcgctcgcaacgaaccggcaaaggtcgtaacaaagcctgttcgcgcaggtcccccgcccgtagcatgccgaaatcatgatcggcgcggcggacggtagagggcccggtgtgacgcacaacgacgaaggcggccccgaagatcggtcgtcgggcgagttcacgctgcgacgtccgttgttcgtgttgacctcggagacggtcaggccggccggtcggcatcggccttccgagaagccgggtgtcagcagcagctgggccggattcatcgcaccgaccggcatcgcgccgcactgcaccggccgggccggctcggccgcggctgccgacggcggagggacgggtggtcacgccccggcccggtcactgcgccgtccggtggcggtggcggccggcgtggccaccgctgtcgccgtcggcctcatcattctcgttcccgatcacgacaggggcgcgccgagtgccactggggacggacggaacggcatcgtggtcgacggtccgagcgccatggtgtccaccccgcccggcgcgggaacggagctgcccggcgcgggcagcgagcccgctacgacgcccgcctccccgcagccgcatgcgacgcagctgcgcaaggtgtcatcgtcagcggcggccaggacgcccgaggcttcccggttcgtggcggtggccggcgagagctgtccgcagagcgcggatcgcggttaccacgtgagcggtcaggccagcgactggtacttcccgtcccgcggtggttggacctccgacggctgcggggggcgggtcgcagccgtgcccatgagcggctcaccgaccagggacgaccgggacaacgtcatcgtgtggtggttccgcaccggaaccgtccgcaccggcagctgcgccgtcggcgtctatgtgcccggcaccggcaacccgaaggacgcggcgggtgagccggcacactacctgctccgtgccgatgacgacatcgatgcggacgtcgtcgccgagttcgacgtcgaccagtcggccaaccagggccgctgggtcgacgccggccggtacagcgtcacctcgggcgagatctcagtccagttggtgacccggggcgtcgactggggcagcggacgcgagggcgaccacctcggcgtctccgcgctgcgggcagactgccgcgccgagtgacgcctgccgatttcctgccgaaggccacgacacggaaggagccaccactgttcgagaaccctgccgttcccaggatccgccagcgcggatcgacgcttctggtcgttgacggcgacgctgagcaggatctgccggagctgccacagctgcccggcgaaacccacgtgaccacggtggtggtgcacaccaccgtggtgccggacatcccggtgttgcggtccttgctcaaccgcggactggcaccggagtgtgcggcggtacggctcgtgctgccgggggcgggcgcaccgggaccggacggctggtgtgcggcccggcaccttgccgagtcgctgaacctccccgtgatcgccccggacggaccggtgatcgtcctccccgacgcgctgttcgccttcggcggagcgtggcggacattccgccccggggccgaacccgtcgtcgacggaccacgacaccccgcccccaggtggcagcgcacgctgaccccgccaccgcaggcggaggcgccgctgcgggcgacgccgatcccggccggactctggctgcacaccgcggaccgggtcgtcgcgcccgatgacccggtcttcgcggtgccggtcgatccggcctcggtgtccctggtcatcggccgtcccggcgatccggtgctcccggcggcagaagtggccgagtacatccgccggctcgcgcccacgatcggcgacgaacccctgctcatcccgtacgggtccggcggccacctcgtcgacgaactcgccgtacggttgccgggcgacgcggtcgcctccgtccgcgtcgacgcgggcatgcccgcggtcgaggcagacgacgtggcggtgcgcaccgtggtggatgccgcgggccgcgcggtctggcggcccccggcccagcagctgcggtttcagcccggcagggcacctcgtctgctgcactggcggccgcctctgccacacgcttcgacggtggggaccggcttgcaacggctcgccgacggctggctggtggaggtggtccgatgcggcctgtggatacgtcccgatcgggaggacgacgacgccgtacggcggatccctgccgatcctgatcgtctcctgctcctggtcggtgcgccgggggcaccgccggcgacggaggtgtggccggcagtgcgccgcctgctcgacgcactgcctgcggaccaacgggagcgggtacagccggtactgcccgccggcacggcccagccttccggattcccggccgcgtggaggctgtccccggatgcggacgcccaggcccgctgacaccatcgatgtcttcgcgcccattccactccggaacagcagaccccggtcgagatgaccgactccgcggccgacccgggtgaggtcaggcccggcccgcggcgccgacgggctgcggggctttggcgaactcgtgcaggatgcgttcgcagaaggccggcaggtcgtcgggggaccggctggtggtgatgttgccgtcggtgacgaccggctcgtcgaccacctccgccccggcgttgcgcaggtcggtgcgcacgctgggccacgaggtcagccgtcgcccgcgggcgacgccgcttcgacgaagttccacgggccgtggcagatcgaggcgaccggcttgccggaacggacgaagtcccgcacgaatcgcgccgccgcgggttccatccgcagcttgtccgggttcaccgtgccacccggcagcagcagcgcctcgtcgtcgtcgaccgatgcctcgccgaccagctgatcgaccgtgaaggcgccggctgcttccaggtcgtggtcgcgcgcctggatctcaccgccggcgatggagaccacgacggtgcgggcgcctgcgccgtcgagggcctgccgcggctgttccagttcgacgcgttccaccccgtcggcggcgaggatggcgatccggcgtccgttgagctctccggccatctcaggcacctgccccggccatcgcggggtgcaggacgaccttcgtccagccgtcgtcgcgcttgtcgaagtgctcgtaggcctcgggcgcctggtcgaggggcagctcgtgactgacgatgaaggacggttcggccttgccggcggcgatcaggtcgcgcagctgccggttgtacttcttgaccggggcctgcccgctgccgatgtgctggcccttgaaccagaacatgccgtagtcgaaggcgagtctgccctgtttggcaagctcgtcgccggcgcccgggtcctggggcacgaagacgccgacgttgccgatcctcccggtgaagcgcaccgaggcgaccagccggttcatcgtcaggttggcctgctcccggccgtccggctcgtgcgcctgatagccgacgcactcgcagccgttgtccgccccgagtcccatcgtctggtccaggacggcctgcaccgggtcgaccttcgagtcgtcgatggcgatcgcgccgatcgactccgccagccgcagccggtcggggtgccggtcgacgaccatcaccttgctcgctccgcggatggtcgccgacagggcggccatcagaccgaccggaccggcgccgtagatgaccgtctggtcaccgggctgcacgccggccatctcggtggcgtggtagccggtcgggaagatgtcggccagcatcacgtagtcggtttgacgctcctcggcgtccgcacccagccgcagacagttgaagtcgccccagggcacccggagcagttcggcctgtccccccgcccatggccccatgtccgcgaaaccgtatgcggcgccggccatcttcggctccggctgagcggtcaggcagtagttcgtcagctgccgctcgcaattcttgcaatgcccgcaggagatgttgaacggcaggaccacgtactcgcccacctgcactttgtcgaccccgtcgccgacctcgacgacctggcccaggttctcgtgcccgaaccagcggccgggttcgaagtcggtccggccctcgtacatgtgcagatccgaaccgcagatgttcgccgatgtgacgcgcaccagcacatccgtgggccgttcgatccgcgcgtccggcacctccttgacgctgacctgtcgcggtccctcgtacaccactgccttcattgctgcctcctcgtcgcaggttgctcccccggcccgggttcgggccgggggtgttcatgacatgcatggacggatcgccggcgacgggggcccaccggattcgggtggcggtcagggtttgaggacgaccttctcgcagtcgtcctgcttgttcttgaacatctcgaagccacggtccgcctcgtccagcggcagcgtgtgggtgatgatccgagtcggatcgatctcaccgcgctcgatccgttccagcagcggcctcatgtagcggtgcacgtggcactggccggtgcgcagggtcagcgaccggttcatccaggcaccggcggggaacttgtccagcaggccgccgtacacgccgatgaccgagaccacgccgccgctgcggcacgacatgatggcctggcgcagcgcgtgcgggcggtcggtctccgagcgcacggcctgcttgatccggtcgtacgcggcgatgtgcgcactgccgtgggtggcctccaggccgaccgcgtcgatgcacttgtccggtcctcgtccaccggtcagctccaggagccgggaccgcacgtcgacctcgtcgaagttcaccgggatgtggccggcctgctcggccatccgcagccggtacggctccttgtcgatggcgatcaccttcgcggcgcccagcacccgggcactgtccatggcgaactggccgaccgggccggcgccccacaccgccaccacgtcgctgggctggatgtcgcacatctcggcgcccatgtagccggtgggcaggatgtcggacaggaacagcacctgctcgtcggtcaggtcggactcgatcttcagcgggccgacgtcagcgaacggcacccgcgcatactgcgcctggccgcccgcgaacccgccggtcagatgcgagtagccgaagatcccggcgaccgggtgaccgaacatcttctccgcgattcccgcgttcggattggtgttctcgcaacaggagtacagctcggcgacgcaggcggcacaggcgccgcaggcgatcgggaagggcacgaccacccggtcaccgacccgcagccggtccgcggacaccccggacccgacctcgaccacctcgcccatgaactcgtggcccatgatgtcgccgtcctgcatcgtgggcacgtagccgtcgaccaggtgcaggtccgagccgcagatcgcggtggaggtgatccgcacgatggcgtcgcgcccgttcaggatcttcggatccggaacgtcgcggacctcgaccttgttacgccccgcccaggtgttcgccctcacgcgtccgctcccttcgccagttcctcgtccgacagcggctgtgccggacgctgcgggaactccttgcgcgcccgcttgccccacggggcgccgtcggatcggaccacctcaccggtctccagcacctgcttgagccggcgcagatcgtcgtcgagctgttgatgcggttcctcgccgaagtacttggcgaccgctttgcccacggcgccacccggaatgtcgtacgtcagggcgacgtgcacctcggtgctcacaccgtcgggggccggtaggaagcgcacggtgccggcgttgggcacgtcggcgttcccggtcgagcgccacgcgatccgctcgccggggatctcctcgacgatctccgcgtcccaggtgacgtccttgccgaacggggcgtcggccgtccaccggctcgtccggtcaccggtggtgcggacctgctcgagatgcgccatgaaggtcggcagattctccagatcacgccagaacccgtacacctccgccgcgggtttgcgaacggtggtcgtggccgtcaattccatgggtcctcccttgtggttggctcgcgccaccggcgtcgggccgatgcgctcgatgcgggtggcctgcgcggagccgccggtcgcgccactgcccgaccgcgactcgtccagccggcaacctgcttggcgaacggcttcccgacgtgcggatacccgcggagaatcccctaaacccggcacccggcctcaacccggtgagcgccggctccctgtggttacggacgaccggctccgccaccggtgtctccgctgccatcacgggagccgccgccgcgacagtgtcctgccgatcgccccgcgatccgccaccaccggcaggcacgggcgggcgtcatcgtcttccaccgggtgcccaacggtgcacctccaccgagtcgtaccgatcacgcgtcagcagagcgcacgccgcctccgggtccgaggccacgagcagcgacgccgtgccgagccaggtcgcgccgtcgtcggacagcagcgggccgtaggcgatcagatcatgtcgccccgcgggtacctcgagatcgacggccgggcccgctccgaaaccgagcaccaggtacccattgtcatcgaccgggccaccggggaagtcccacatcgtacgtccgagggcattccgccatcgccgcagcaccaggtcccggtacacaccggcttgatggttgggctcgtcgaaggcgaatgcgcgggcggcggcagcaccggagagatctgcgatgtgcaggcttcccgtcggagcggtgcggtccggtgacagcgtcgggccgcgggcgatcatctccttctcgaaacgatccatgtatgcccaatgggcttccgtcagttcgtgacgcagcgccagcgagccggggcggtctcggtggtagcacaggaactccatgccgacagcctcgcaccacgaacggtcggcccgcggcggcgctcgatgtcacaagtgtgtcggagaccgacatcgaccgatacttgtgcatccgaatacggcgatgaaagatcgcggagaggttgatcgggatcttgaggagccaggtggggctccccccggtcgccgcgcgcgaggagcactgcatgccacgttcggcacgaggggtgctgacagcatctctggtatccctgggggtcctgaccgccgctgcctatccggcggcggcgttcgcggcgccccctgtcgtcaagctgccggccaccgccggccagccggctcgtggcgtcatcgtgatgctgcgcgaccagcacaaggacctgaaggtcacccgcagcagcaattcgccgcgtgcgctcgccgaccgtaaggaccaggctccgctcctcagccgcgcccggtccgcgggtttccgcgacctgcacggattctcgaacgtcaacgcgttcgccgggaccgcgacggccgcgcagatcgccgccctgaccgcggatccgtcggtggccgccgtcttcccggacctgccgatcaccaagacgccggtggccgggcggcccgaggcggcggccgccacccggaccagccccgcgaccagcaaagcggcgcagatctgcccgaccgatccgagcaagccgctgctcgagccggaggcgttgcagacgacgaacacggcgttcggcaatccggcgacgccgcaggcgcagtcgctggcgaccggcgccggggtgaaggtcgcctggctggccgacggcatcgacatcaacaatccggacttcgtccgcgccgacggcagccacgtcttcgtcgactacaaggacttctccgaggagggtccggacgcgccgagttcgtcggccgaggccttcggtgacgccagctcgatcgccgcgcagggccgccaggtctacgacctgtcgacctatgtcaacccggcgcacccgctgccggccggctgcaccatcaccgtgcggggcatcgcaccgggcgccagcctggtcggcctgaaggtgttcggcgccgcccccaccgcgcccacctcccggttcatcgaagctctcgactacgcggtgaatgtggccggggtcgacgtgatcaacgagtcgttcggctcgaacccgttcccggacctgggcaacgacccgatctcgctggccgacgacgccgccgtcgacgcgggtgtcacggtcgtggcgagcaccggtgacgccggcctgaccggcacggtcggatcgccggccagcagcgccaaggtgatctccgtcgccgcgtcgacgacgttccggtcgtacctgcaggagggctactcgggcgcccgtgacttctccaacggcacctgggccagcggcaacatctcgcagatcagctccggcggggtgacccagcgcaaccgggtgcccgacctggccgctccgggcgacctcggctgggcgctctgcacgccgaatccggacgtctacgtcgactgcaccgacgacaagggtgacccggcgtcgctccagaacttcggtggcaccagccaggcatcaccgttcacggccggtgccgcggcactggtcatcgaggcgtacaagcggacgcacggcggcgaccggcccaccccggacctggtgaagcggctgctcaccagcaccgcgaccgacctcggctacccggcctcccagcagggtgccggccagctcgacacgctcggcgcggtccgcgccgcgctgagcttcaaggacggcaacggcgcgccgcaggcgcagggcacctcgctcgtcgtcgaccgcagccagctgtcggtcgccggtcagcccggccacaccgtcacctcgaagctgggcatcaccaacgtcagccgcaacacccagaccgtgcggctgtccacccggacgctcgggaaggccaccagcacgacgaacggcacggtcacgctgaactcggcgacggccccgaccttcgtcgactcgaccggcatcgtgcgcagttacgtgatccagaagttcaccgtcggcgtcggtgccgaccggctcgacttcgcgctgaccggggcgtccgcaccgggagcgctgaaggccagcctgatcgacccgcacggcacgttcacgtcctacacgttcgcgcagggcgccggcaactggggccacaccgacgtgcactacccggcgttcggcacctggaccgcgatcatcttcatcaccaaggcggtcgggttcaacggcccggtccactaccaggtctcgacctcgaacttcgcccgcttcggtacggtgtcgccgtcgacggtgacgctggcgccgggggcgagcaagaaggtcacggtcagcacgaagctgccgtcgaacccgggtgacaccagcgcctcggtgcagctgtcgaccccgctcggcgtcaccgtctcggtgccgctgaccgcccgcacgctgatcccggccgggcgtgacagcaacagcttctccggagtcctgcagggcggcaacggccgtgccggcgccggcgggaacgcccagtcgaacttctactacatcgacgtgccggccggtaagaaggaccttggcgtgagtgtctcggtggccgacccggcggtgcagttctccggcgtgctgacgtcgccggacggtcaggtctactcgtaccagagcaaccggtacgtgaccgcggccggcgaagcgaccaacgacaagtcgctgcagctgtaccgacgcaacccgcgggccggtcgctggacgctggcgctcgatttcaccaacccgcagagtggggccgaggtcagccagccgttcaccggcaagctcaccttcaacacggtgaaggtgtcggcggcgctgccgtccaaggccacgctgaccgcgggcaagccggtcaccgtgccggtgacggtgaccaacaccggcgccgcgccgctggcgtacttcgtcgacggccgcctcaccaccaccggcgacctgccgctggccgagatctccggtgcgccggggaccatcgatctgccggtgccggccggcatcgtcccgcagtggatcgtgccgtcggaaagcaccggcgtgaccttccaggcgtccgccaccctcccggtgaacctggacgtcttctacaactccggtgagccggaggtctactcggccgcgcagggcaacagcgcggtcgtcaaggtgcaggcgccgctggtgtcgccgggcgtctgggccgccgacatcggcgagagcgggccgttcgacggaccggcgccgatcggcacggtgcaggtcgcggcggtggcccacacccggctcttcgacccggcggtgacctcgtcgaccggtgacttctggcagaccgcgctgtccggcgcgccggacagcgcgctgtcctcggccgtgcgggccaacgccaaggccggccggttcgtcaccgcggccgggagccgggccgcggccgccccggcgccgatcgtggtggctccgggcaggtccgcgaccatcctggtgaccatcaccccgagcgccccgcgcggcaccacggtgcgcggtcacctgtacgtcgacacgttcagccagatcactgtctccggtgacgagctgatcgacctgccgtacagctaccaggtcggctgaccgggccgatacacgagcgggggacggcatctgccgtcccccgtttcgttgcgtcggatcgcgcgggccatcgatcagccccggtacgtactaccttcttcgaaagttcgatgttttacgaacaaagaaagaggcgggtatggcatcgaccggggcgcgcagggtgtcgttactggcgttcgcgacgctgttcgtggtgggaacggacacctttctggtggcgccactgctgccgaccctctcccaggcattcggcgtcggcaccggtgtctcggggtggatggtgagcgcgtatgcgctcggctatgccgggctggccctgttcgccggcccgttctccgacggacgggaccggcgcgccgtgctgctcggcgggctgctggcgtttgcggtgacgaccgcgctgtgcggattcgcgcagggtttctggagcatgctcctgttccggttcctggccggggtgagcgccgccttcgtgaccccgcagatctgggcgtccattccggtgctggtggcgccggaggtcgtgctccggacgatgggattcgcgacggccgggctgtcgatcgcgcaggtggtcggcgttccggtcgggagctggctggccgcggtgtcgtggcatacgccgttctgggtggtggccggggcgtcggtgctcctgtggctggcgctggcgcggctcttcccgtcggtagggtcaccgtcggcgggcgggatccgacagacctacgctgccgtgctgcgggatcggacgctcgtgctctacctgctggcctacctggtcttccagaccggcaacttcgaggcgttctcgttcatcggatcgtggctcacccgtgacttccggctcggggtcgccgaggtgggcaccgcgatgatcgcgctcggtctcggcaacacggccggagcgctgttcggcagccggctggtgcgacggatcgggcaacgcacggcgctgctcaccgcgtacgccatcctgatgctgtgctatgcgatgctgccgttcgcgccgggtctgggcatcgcggtgacgctgttgacggtgatcttcctggtgggtggcttcatcttcccggtcttcatgacgatgctgcagtcgcgggccacggcggcgcgcggcaccgtgtcgtcgctgtcgaacgccgcgatgtacgccggatcgacggtgggcggcgtggccggcggggtgctgctggccggcgtcgccgggttccatggggtcgcggcgttcaccgtcgtcgcgtacgcggtgtccctcggtgtgttcgccgcggccggcgccctcaagcggcagccgtcaccaggctcagcagcccgggaaaccgccgctccagctcctcggtgcggaccttcacgaaacgatgcgtgccggacagccgggtctgcgtgatgcccgattcgcgcagcaccttcaggtgatgcgacagggtggacctggccatcgcctcgcccagggagttgcaggactgttcggtgcccagcgcgatcagggtccggacgacctccagccgggccggatcgctcagcgcgtggaagacgttcgccagccggaggtcctcctccgccggatgcagcagcacacgcatgtcgcgacctccgcacgattagttcgatgatagtagaacgaaggatccaccggatcactcgtgggcagtgcgggaccatggcggaaagaaggacccatccggagcgggcagggctgcgaagtacggggtggatgaccgggcgcggagaagggctgaccctcatggtggaacgcggcacgagccgccgggcggagcacctcacgccggtggcccaaccggagaccgaggcgccaccggtgctggccgacgagctgttacgggccgtcggccgcggtgacgagcaggccttcgggcgactgtacgacctggtggccccccgggtgtacgggctgatccggcgggttctgcgggatccggcgcaggccgaggaggtggcgcaggaggtgctggtcgaggtgtggcgcaccgcggcgcgcttcgatccggcccgcgggtcggcgaccgcctgggtgttcacgatcgcgcaccgacgcgcggtggaccgggtgcgcgccgagcagtccgcgtccgaccggaccatccgggccggtgcggcggcgctggacacgccgtacgacgcggtggccgacgaggtctccggtcggctggaacgccagcaggtacggcgctgcctggacgtgctgaccgagctgcaacggcaggcggtgaccctggcctactaccagggtcactcgtatccgcaggtggcggaattgttgaagacaccgttgccgacggtgaagacacgcatgcgcgacggcctgatccggctgcgcgactgcttgggcgtggaggtgacggcatgatcgcggacattcattcgctggtcggcgcatacgcgctcgactcggtggacgatctggaacgcgccgccttcgagcggcacatcggcgattgcgaggcctgccggatcgaagtggccgagctccgcgagacgaccgcgcggctggccgacagcacctggtcggcgccgccgccgcggctgcgggagaacgtgctcgccgcgatcgcgacgacccggcaggcgccgccgctgaccgcggcgacgccgtcccgcgaacgggccgcgacgcgggcccggatgtcccggcgccagctgttcagtgccgcggccgccgtcgtggtcgcggccgccggggccggcacggcggtctacacgatccaggatcagcgcgtacgcgatgagcgggccgccgccgaggccgaccgtgacctgcaggcacgggtccgggccatcctcggctcccccgacgtggtgctgcgcggcgagcagctgcgggacggcggacgggtgaccgtggcgtactcccggctgcgcgacgccggcgtggtcaccctcgcggctgacggtccacccagcggcgggcgggtgtaccagctctggacggtccgttcccgggtgccggtggacgagggcgcccttccggtcggccagtcctcggtcgtgaagatcgtcgagcgcatgtcgtccgccgaggtcgtcggcgtctccgaggagccgcccgggggttcggcccggccgaccgacatggtggccggcgtgaaaacaatctgagatccgacccatccgcggcatggttcgcaccgaatacggggtgaaggtcccgatataggaggaacaaaaccatgcgcgcaacgaagctcaccgccctggccgccgcgaccgtcttcgcgatctcgttggcggcctgcgggagtgactcggacagcaacagcggcagcggcacggcggcggccccggcgaccaccgccgccatgcccagcgcggccccgagcatggccaccgacccgacggtcaacttcggtcccggctgcgccgcggtgcccgccgacccgtcgaacgcgggcagcttccaggccatggccaaggtgccggtcgcgaccgccgcctccggcaacccgctgctgtccaccctggtcagcgcggtcaagcaggccgggctcgtcgactcgctgaactcggctgacgggatcaccgtcttcgcgcccaccaacgacgccttcgccaagatcccggaggcgacgctgaagaaggtcctcgccgacaagaagacgctgaccagcatcctcacctaccacgtggccaaggggaagctcacccccgccgacctggccggcagccacgagaccctgcagggtggcaagctcaccgtcaccggcagcggcgaagacttcaaggtcgacggcaccgcctcggtgatctgcggcaacgtgcagaccgcgaatgccaacgtctacatcatcgactccgtcctgatgccgaagaagtgaccggcggcaaaccggccgcgacgatcagcgggatcgtcgcggccaccaccgggtcgcggccgcggaactcctcgcagccgcgacccggcaggctcaccgccggtcgcggtgatcgacgccgctccggtcgccgtcaaggatttcgcggtacgcgggtggggcgtccccgacaagccggccctgctcgccgcgaccgccctggccgaccctgctcgcggcggcgaccgggctgacggcgaagcggtggcgcccgcccgcgatcgcgggcggaaccgttccccgggcggccggggtggcggcgacgctgacccggccgcgcaattccgcgcagcgatccggctgccggcgccggcccgccccgtgcccgacggcggggcgccccgaccgctcaccaccaccgggcacctctaccgggtggacacggcgctgactgtgccacgcatcgctgcggcgagtgccggctgcgcatccacggcatagtcgacctgtcgccggccgacctgctgcgccggccactgatcgaacgcgacatcaccctcaccggtgtctccggtgaggtcgccggcacggcccgtggcctcggggcgccgccggccgcgctgctgcgcgaggccggagtgcgggccggcgcggaccggatcctcgcccgctccgccgacggcatgacggtcggcacatcgctgagcaccgcgctggacgggcgcgacaccatgcccgccgtcggcatgaacggcgagcccctccccctcgacccggcttacccgtccggcagccggaggcccgcgccgcaccgttcccggacggggtgaccggctggcacaccttcacgccaccgcgacccgacccccggtacgggagtgagcggatcgtccggaatgcggaccgcctcgatccagagtgggtggcgccggccggccgcggcgcatcaggtcggcgatcacgctcgccgggccgggagcgtgggacggccacggggtggcgtcgacgggtcggtgaagacgacggcggcgcgtccgacctcgcgaaacgctgggcgcctcgccgccgggagcttgacatgtgaccggatggtcacataactttgcgtcatgacggacgacgatcgggtgttcaaggcgctggccgacccgagccgtcgctttctgctcgatctgctgttcgtgcgggacggtcgcacgctcaccgagctggagaccgagctggagatgacgcgcttcggcgtcgccaagcatctgcgggtgctggaggaggcgggactcgtcgtcacccgccggtcgggccgggagaagctgcactttctcaatccggtgccgatccggcagatccacgaccggtggatcgacaagtacaccgagcaccagatcaccaccctcatcgacctgaagcgcacgctggaggaggagtcatgagcgagaccaaggtgttccggatctggatcaaagccacgccggagcggatctggcaggcgatcaccgacccggagtggaacgcgaagtacggctatgccaccccgcagtacttcgagctgaccaagggcggccgataccactccacggccaaccaggggatgctggactacgccgcggcgcagggattcgagctgcccgacccgattctggacggcgaggtgctggaggcggaggccccgcgccggctcgtgcagacctggcggatgctgatggatccgggcaccgcggccgaggggttcaccacgctgacctacgagatcgaggattcggcgcccggtgtctgccgggtgaccatcacgcacgacgtgacggacgcgccggcggtgggcgccatggtgtccggcaacccggacccggcggccgagggcggcggcggctgggcgtgggtgctcagcgacctcaagtcgttgctggagaccggcaaggtgctggctgacgcctgatccagccgtccgggacggtcctgcgcgatgggggccgtcccgctacattccgggcatgacggtgttctggttcatccttctcggactggggacggcgatgagcgggacggccatctggctcgcggcccgggatcggcgccgcgggcgggggtgacgggtcagccgacgtatcgacgggccgccgagcgccgctgcgcctcgtccaacgacgcgaggcgcacctcgacccggtgcgggcgggcccgccgctcggcgagcagccagcccaggccgcgggccgcgtcgcaggccgcgagcagcgaggtccggtcgcggggcacggtccgggccagaaagagggtccggcgtacggcgggggccagcggtcgccgcagccaggtgaaccagagggtgttgcgcagcccgacccgccgccggtgggtggcgtcccgcagtttcgacgcgtggtggtgcacggtcagatcctcgcggtagcagagttcccagccggcgctgaccaggtcggtggcgagcagctcctcctcaccgcccagccagagccgggcgctgaacccgccggcctgctggaacgcgtcgcgccgcagcaccgaggcgccggccaggaagctgcccagcgccgggccgggcagccagtccggggcgggcaccggtgagtcgcgcagctcggcgacgatcgggtcctcggcgccggacggctcgaccacgatccgggcgttgaccacggccagccgcgggtgggcgtcgagcaggtcggcggcacgggcgagcgagccgggccgccaccacgtgtcgtcgtcgcagaaagccacgtacggggtggtcaaccggcggacccccagattgcgaccgaccgcgcccaggttgcggcccgcggcgatgacgtcgacctggggaaaggcagcgcggaccgcgccggcggtcccgtccgtcgagccgttgtcgaccagcacgacgggcggctgctcgggcagggccagcagccgctcgacgcaggccagcgcctcctcgcgccgctgccaggtgatgacgacgacgccgacccgtggatctctcacgagcccgcgcaataccccgatccgggctcagaacacgtgcttgacccagtcgaaggccgtcatcacccattcggtctggtgcaggaaggcgaagccggcgacgaccaggaacagtccggacacgaggtgcgcgccgcgggcggtgtgccgcgtccggttcaggtaccgctccagcaccaggcgtccgaccagccgggcgagtgcgaacacgccgaccccgaccagcagcgtgagcagcagggcggtcagcgggagggacagcgaaccgctgccggacagcgcccagatgccccagcagacgaagacgaacagcgcggccgcggtgctccactcgccgccccgacgtagctggtccacgtgccagcgcaggctgtggcgcggacgcggcggctgcgcgccgggccagccggtgccggtcggctcgtgggtcgcggtcggctcaggctcacggtgcacgcgcgggttgacctgcgcgcgcccctggctgaacggtgactgcgggctcgccggcgggtgcgggctgaccggcgtcggctgggtggcgtcgaactcgtgcaccggcgacgtgggctgatcggcccacggatcctgcggcggcatgtcgagcgtccgctccgaccactgcggttgctccggcatgattcccctctcgcctgtgagcggccggacggccgtcagttccgagagtaacgagcgcgcaaataggtggccggaaccacgacggtccgttacacaagctccatggacggcattgacatccggcgaggttccagcgccgacatccccgcggtctgcgacctgatcggcatcgtgttccacgaggatctcaccgacgagggcagacaggacgaggccgaggtcttcgagccggaccggtcgctgatcgccgacgaccggggcgtggtggccgggcacacgctgacgcattcgcggcatctcacggtgcccggcggggtgctgccggctgcgcacatctccagcgtcggggtgctgccgacgcaccggcggcggggcatcctgaccgcgctgatgcgccgccagctcaccgagatcgcggccgggccggagcccatcgcggtgctctgggcgagcgagacctcgatctatccgcggttcggctacggcctggccgcccaccggttcaagctctcgatcgagaaccgcgaggtccggctgccggaccggccggccggccggctccggatgggtgacccgggcgacctgcgtgacgatctcgtcaagatgtacgacgcgatccgcccgcagcgggtcggctggtcggaccgcgacgaccgctggtggcgccacgtgctgcgggacatggagtcgcaccgtggcggcgccacccggcggcgcgcggtggtccacgacggcgcggacggcagcccgaccggttatgcgctgtggcgggtcaagccccgctcgaccgcccacggcccggcctgcgaggtgcaggtccgcgaggtggtcgccgccgacccgcagacgtatctggcgctctggcgcttcctgctgagcatcgatctgagccgcaccgtcaccttcgacctggccgcggtcgacgagccgctgcagtacctggtggacgagccgcgccggctcggtcccgagttctccgactcgctgttcgtccgcctgaccgacctgccggccgcgctggccggccggcggtacgccgccccggtcgacgtggtgctggaggtcgacgatccggtcctgccggccaacgccgggcgttggcggctcaccggcggcccggattcggcgacctgcgtgcggaccggcgacccggccgacacggtgtgctcggtgaccgatctgggcgcggcctacctgggcggcacctcgctgtccgcgctcgcggcggccggccgggtacggcagctgaccgccaacgatccgggcgtggcgttcggctggcaccgggcgcccagcgtgaccgagacgttctgagaggtaccgtcgggaccatggctgagcccgaacgccgccgccggcgcgtccgcccaccgtcgggcaccactgcggccgagccgcccgtcccggtgccgggaccaccgccggtcccggtgccggcggcgggaacggtgcccgcgccgggaccggtgcccgcgccgccgccctagctagctagcccgtggccaagcggcccgccgcgccggccgccgctgaggaccgggaggccgagcgcggtctgcgcgggctggtcggttccggctcgtcgcaggtgggtgtcggtgccgcgctgcgcgcccgggacgcgtcccggcccaccgaggcggatctcgcggcggccgaccgtgacctggtgatcgtccgccgcaactggcttccccgggaggatctcccccgccgctgattacgatgtgcgggaccaccgtcgctttctggaaacggctgaccaacacatgcagtggaagaaccgccccaatggcctgacctggtcaggagtcatcaagaacgaggaagccaagcgggaggcggcggcccggctggccgccgagctgcaggacgggcagaccgtcgggatcggctccggctcgaccagcttcctcaccctgcaggcgctggccgcccgggccgcggccgagggcatcgcgttcaccgcgatccccacctcgatcgaggtggccaacgcctgcgccgcgctgggcctgcgcaccgcgacgctgaacgaggcgcgccccgactggtgcttcgacggcgccgacgaggtcgacccgaagaagcggttgatcaagggccgcggtggcgcgctgtaccgggagaagctgatgatggccgcggcgccgaaggcgttcatcgtggtcgaccagtcgaagatcgtcgagcgcctggggcagaacttcgcggccccggtggagatcgacccggacgcgttgagtctgatcttcgagcagctggcggactttcccgggctggacgaggtcaccctgcgcccggccgggggcaaggacggcccggtcatcaccgagcgcggcaacctcaccctcgacctgcggttcagcgagatcgccgacgacgcgcacacccggctcaagcagatgtccggcgtcgtcgagaccggcctgttcttcggctacgactacgaattgatcctggccggataacggctagaagatcaacgcggcgcggagcgcgaaggccacctgatcggccgccgcccgcgccgcgtcgatcgtcgcgatcttccgggcgaagccgtggttcatccccatgtagcgggtgtgcaccaccggcaccccggccgcgatcagcgcgtccgcgtaatcggcgccctcgtcgcgcagcacgtcgtactccgccgtgatgatcagcgtggccggcatcccggacaggtcggcgaccgcgaggggcgccacgtccggggtgagccgcagcgccggctgcggcacgaaggtctcccaggcgagccgcatcgaggcccggtccagcccgtactcccccagctcgtcgtacgactcggcggaggtcagcgggtcgagcgccgggtagatcagcgcctggaagtccagcggcgtgccggcgtcccgctgccggcgcgcggtcacggtggccagctggccacccgcactgtccccgccgatcgccagccgggacgcgtccacacccagctccgcggcgttcttgcggacgtggtcgagcacggtggcgacgtcgtccagcgcggccgggtggacatgttccggggcgagccggtagcccaccgacagcaccgccaggccggaccggtcggcgacccgccggcagaaccggtcgacggtctcgatactgccgtagcaccagccgccgccgtgcagatagaccagcagcggagcgccggcgcgggtggcgtacagccggcacggcaccccgtcggcgtccaggtcggcgacgaccggcaggggcagcgccgggccggtctccgcctcgttggactcctccatcgcggcccgggtgtaccgcagccgctcgtgggggctgcccgccgactcctcggcggaggggcggcggcgaagtctcgccgccgccgtcacctgcgggtggagcatcagccgagctgcgcgaggaccaggccgccccgcgctttcggggtgaaccaggtgctcttgcgcggcagtttcagccgggccaggttgacctcgacgaaatcgtcgacggtgaccggggcgatcagcacggccagcgcggaccggccggcgtccacctcgccgcgcagccaggcgaccgggtagtcgccgccgatgtaggagatccgcttgtcgcccggctccaggcccagcacgtcacccagcagcacccgctccaccagggcgtggtcgaggttctccacggcggtggcggacgccgcggcgggcaggccgaccgcgaacgtgcggcccgcggcgtacagctcgatcgtccccttggcgggcagctccgcgggacgcggcagctcggtgaccgtcgcaccggcctcgcgaagccgctcggcgagctcgtcgggcgtcaccgagatgtcgccgaccaggcggttgtacggctggatcgccaccgacgcgggcgtcgtgatcaccgcgaggaatcgcggcagcccgccggtctgcgcggccaggctgcggtggttgccgtcggcgaccaccagctcaccgccgccggccagcccggtcagccggtcctgcagcgggcccgcgccgaccacccagatggcgtgggtgcggccgctctggtcggtatcggtggcctccggctcgccggccgcgtcacaggcctgcgccagcgccgcgtgcagttcctcgcccttgccggtctgcagcagcagcaccggggagagcagggtctgcagcgccccggccagcgcgacccgctcgcggaccttggcgatgaacacgtcctcgttgcggatgaccaggcccggctcgtcggcgctggtggagatctggtcggtgtccaccatgctccacagcccgtacgccgcgggctcgtccttgccggtgatccggtagagcaccacgacgtgctcagcgtgccggtagtggccctcggacttgtcgcgctccagccggacgacggcgtccgggaggctgtccgcgaaggtcttgccgagggtctcgggcgcgaggtgcggcatctccacggccagcgcgctgtgcgggttggcggtgatgatgtcggtgatttcggcgtcgtcggcgaactcgtcgtaattctgggcgccggtgccgccagtggtgatccaggcccggctgatcgggtgcacgaccgtcatgcctggcaacttacccggcggtgtgccggtgccggcccaccggcatgttcccgcgtgaccggctcaactgtgcgcgtcgatgcgcgttcaccggtcgtttcaccggcccggtggtgacgatgatcggcggggcgacgagttccgccagctcaggggataaatccggccatactgcgcgttggacgccgacggtcacgccgcccgcgtcgctggatgaggtgtacatcaccccatccaacgacggcaccggtgaacaggtggcgaaccagtcaaaaagaactagtcgaaaatcgggccgatctcgcggctgcgcttgatctcgtagaagccgggtgtgccggccaccagcaggacgccgtcccagagcctgccggccgcctcgcccttgggcgccggcgtgatcaccgggccgaagaacgcgaccgtctcgccgtcgaccgggccgggcgcgtggatgaccggcgtgccgacatccgtgccgaccggcttcatgccggcgttgtggctggcccgcagcgcctcgtcacgctcgtcggtgagcgcggccgcggccagttccggatcgaggccgacctcggtcagcgcctcgcggaacagcttctcgtccaactcgtacttctgcaggtggatccgggtgccgagggccgtgtagaggtcacgcagcacctgcgggccggcggtctcggccgcggcgatgcagacccgcaccgggccccagcccttcgacatcagttctcggtactgctcgggaaggtcgcggccctcgttgagcacggacaggctcatcacgttgaatcggacgtcgagggggcgcaccttctccacctcgagcagccagcgggaggtgatccaggcccacgggcacagcgggtcgaaccacatgtcgacggtggcgcgttcagtcatacatcgatcctgccaccaccgggacgcgcccggccgcataggcttcgggaaaagcagtcagctcgaaggagagtgcacgtggccggtgttcacaacctgacccaggtcgaggccgcggagcggagtcgattgctcgaggtgaccgggtacgacatcaccctcgatctgaccgacggaaacggcaatcccggttccggcgtcttccgctccaccactgtcgtgacgttcgggtgcaccgagcccggcgccgagacgttcatcgaggcggcggcggtcaaactgcaccgcgccacgctgaacggcgaaccgctcgacctggactcctggtcggcggagaagggtctgccgctgcccggtctggcggccgagaacacgctcgtcgtcgagggcgacttcgcctactcggcgagtggccagggtctgcagcgcagcgaggacccggtcgacaaggagatctacctctacagccagttcgagaccgccgacgcccagcgggtgtacgcggcgttcgaccagcccgacctcaagagcgagttcacctggcacgcgaccgcgccgaaccactggaaagtggtctcgaacatgccggtcgagcgggaggagccggtcggcgcgggcgcgcggaccgtccacttcgcgaagtcgccgcggatgagcacgtacatcaccgcgatctgcgccgggccgtaccacgaggtccgtgatgcgcacgacggcatcgagctgggcgtcttctgccgcgcctcgatggcccgatacctggacgccgacgacctgttcctcatcaccaagcagggcttcgacttcttccacgagcagttcggggtgcgctacccgctgcccaagtacgaccagctgtgggtgccggacttcaacgccggcgcgatggagaacttcggctgcgtgacgcacgccgaggcgcactacatcttccgctcgcaggtcaccgactacgagtacgagcagcgggccaacacgatcctgcacgagctcgcccacatgtggttcggtgacctggtcaccatgcgctggtggaacgacctgtggctgaacgagtcgttcgccgagtgggccagccactggtgcaacacgcacgccacccggttcaccgacgcctggtcgacgttcctggccatgcgcaaggcgtggggttaccgccaggaccagctctcctccacccacccggtgtactgcgagatgccggacctggaggcggtcgaggtcaacttcgacggcatcacgtacgccaagggcgccagcgtgatcaagcagctggtcgcctacgtcggactggacgcgttccggaccggcctgcgggcctacttcggcaagcacgcctggggcaacgccaccttcgacgacctgctcaccgagctggagacggcgtccggccgggaactgcgcaagttcgccgcacagtggctggagaccgcgcaggtcaacacgctgcgcccggtcgtcgagctggacgacgagcagcgctacacccgcgtgacggtgctgcaggaggccccggccgactacccgacgctgcgcacccaccggatcggcatcggtctgtacgacctggacggcgaccgtctggtccggcgcgagctgctggaggtcgacgtggccggcgagcgcaccgagatcaccgcgctggccggggtcaaggcaccggacgtgctgctgctcaacgacgacgacctgacctacgccaagctgcggctggacgagcgctcgatgggcgtgctggtcggccacatcgccggcttcgagtcgtcgctgccgcgggcgctgtgctgggcggccgcgtgggacatgctgcgcgacgccgagctggccgcccgggactacgtgcagctggtctgctcgggtctgccggccgagagcgacatcaacctgaccaccgccaccctgcggcaggcgggcagcgcgctggtcagcttcgccgacccggagtgggcgccgcagggctgggcgatgctggccgagctggcgcagagccggctggcggtcgccgagccgggcagcggatggcagctgacctgggcgcgggcgttcatcaccgcggcgcgcaccgaggagcaggcggcggtgctgcgcggctggctgaacgacggccgggcgccggccgggctggtcgtcgacaccgagctgcgctggtcgctgctgcaggcgctggccgcgatcggggcggccaccgcgcaggagatcgacgaggagctcggcggggaccggacggccagcggcgagcgggaggcggcgatcgcccgggcgctgctgcccaccgcggagaacaaggcgcgggtgtgggccgagctgaccgggccgcaggccctgccgaactggctcaaccggtcactgctgcagggcttccagagcacccggcaggtggctctcacggcgccgtacgcggagaagttcttcgccgcggtgggtgacgtgtgggcccgctcggacagtgagccggcgcaggagttcgccaccctggcgtacccgagcttgcagatcagcgaggacacggtcgcgctgaccgacgcctggctggcgcaggacgggcatccggcgtcgctgcgccggctggtggccgagggccgggacgggatcctgcgggcgttgaaggcccgcgcgaaggaccgctccgcgggctgagtcttcgcatattgcaagttgcagcggccctggctgagtaggctgacatcccgcggtgtgggaggtggcccgtgacgatgctcagccagggttcgccggcgcgctggaatgcgccggtcggccgatggaccgaacccgacctgcacctgttcccgcaggacggtcatcggtacgagatcgtcgacggcagcctgcacgtcaccccgccaccgcgggacgcctcgcacgacgccgtggtcgaggcgatcgtcacgacgctgcgcgccgccgccccgccggactggtgggtgtgcgtccgactgggcgtggagatcgcggagagcagtctggtgcccgatgtgaccgtgctgcgcccgcggtcgtccggggcggtctgggtggacccggccgacgtggcgctggtggtcgaggtggagtcggcggagacccggctctacgaccggctgctcaagcccgcggtgtacgcgtcggcgggcatcccggcgtactggcgggtcgcgcccggcctgctgaccgtctacaccctggacgatggggagtacctgcatgtggcggagggcgccgagcatctgcgcctcgacgccccgtatccggtgcgggtgaccccgaagggctggttctaggccctaccggcgtgcgaggccagctggtcgaggccgatcagcaggccgcccagcaggtcgccgccggagaacgagccggccatgccgaaggcggccagtttcgcgtcgcggtcggtgatccgccggcgggcctcgtcaccggtgacgatctccagccggcgctggtccggcgagaccgccagcagcacggcacgctgcggattccggatctcggcgtggagtttctcggcggattcgcggaccggctcggccagctcaccgagatagatgctgaaggtcaggccggtcgcctggtcggccaggcgcagcgcctcgtcgaggcgcagcagctgactcgtcgtgaagggagtctcgcgatcggcgtcggccagctcaccacttgtcacttgcgcctcctgtcgggccgggccggaccggggcgccggagctgtcctcgatgaccagtccacgctcgatcgccggggtcgcgtgcccgtgaccggccgcggcgcgctcgggcgcggccaggaaccacatcggggcgaactcgtagggccggccggggcggtagcgccgggacggcttgcccttgccggagccggcgaacacgatgacggcgaccgtgccgatgaccgcggccgggatgatcacatagaccagaacggtggtggttacagacacctgtctcacgccccctcgaacatcaatcacggtagcggagcgcaaatggcgccggacgctggggtgctctcacgccgtcgggatctacgcggatggggcgtggcgatgcgaaaatcaccttcacgcgccgtccgcgggcttttcgacgcgaacggcctggaggggggatcccatgcgcctggccgtcgctctcgttttcccggtgctcgccgccgtcctgctgctgccaccacccgccgcgcgggccgccgcggtggtctacgtcgagctgaacccgagcaccgtgcgcgccggggacaccgtctcggtgcgcgcctcctgtgacgacaacctgaaggcggccgcggtcagcgccgccccgatcgggtcggtcacggtcgagccgcagtacggcttcctgaccgccaccgcgacggtgccggtcgggcaccgggccggcgactacccggtgaccctgcactgcccggacggccggacggcgaccgccaccctgcacgtggtcgcccgggtggagccgagccgcgggccggccaccggggggcggcggcaccgccccggagcggatcgtgccgctgctggtcggcggcggcctggtggccatggtcgcgggcgccgcgctgggcctggtgtcgatccgccgccggcgggtgggctgaggccgcggtgaccgacccgaccggaaagccgccgcacgtgccggagtcggtgcgccgcaaacgcccggcccaggtgatcaccgccccaccgccggggacggtgaccgggccgttgccggccccgcgcccgcagggcggccggccggcgttccgggtgccgctgccacgccgtacgcccacgccccggcccgccccgggccgtcgccggcgctggccgatcggctggatcgcgctgatcctgttctttctcggcctgttcgcggtcggcatgggcctgggcgtggcgaccggcttcgacctggggatgttccgtggcccggacgcgccgccgccgcgctccttcccggtgctggagccgagccgcccggaacggctgagcattccggagctgaaggtcgatgcgccgatcctgcaggtcgggttggccggcgacgggtcggtggacgtgccgccgctgaaccggcacaacgaggtgggctggttcgacggcgggccgacgccggggcagttcgggccggcgctgttcgtcgggcacgcggacacccgcaccgggccgtcggtcttccacgacctgggccggctcaaaccgaaacagcggatcgaggtgcgccgcgcggacggcacggtggcggtcttcgaggtgaacgcggtcgagcactacgacaaggaccagctgccggtgggcaaggtgtacggcgattacagccggccgtcgctgcggctcatgacctgtggcgggcggtggctcgggggcgagcagggctactccgacaatgtggtcgtctacgcctcgctgatcgactcccggaaatgattacgccgcctcggcttccagggccggggcggcgtgattgtcgggcaggtcgagccagtccatccagcggggatcgggcgtccggtgcccgagcacccgccaggccaccccgcgcggcgcctgcggtatcgcatgcagccgccagccgagctcggccggggtcttgtcacccttgctgtggttgcacttggcgcaggcggccaccacgttgtcccaggcgtgcaaaccaccgcggctgcgcggaaagacgtggtcgatggtctcggcggagccccggcagtaggcgcagcggccgccgtcccgggcgaagatggcccggcgggagagcccgacatgggtgcggtagggcaccttcacataccgcgtgaggcggaccacggacgggaccgggagctgctcgtgcgcgctgtgcaggatgccgtcgccgtcggacacgcactccgccttgtcggtgaggacgaggatggtcgcccgacgcaccgatacgacgcacagcggctcgtaggtagcgttcagcaccaacgcggaagagcccactgtgggtcgtatgtcaggcatcctgatcacctttccggtgtccgttgctgtgtagcgctcccgtagctcagccgtgtgtgatctgggcctcgctgacgaagcctgtgcgccaatagtccctgatggatgaccaaattgcgagcgttatctgtagccggacggtaaacgtctgacgtcatccacccagccggacccggtaccttgactccccgtgttccttgctccgtcaactcccgatcccagtcttccgacggtcaacctgaccaagtcgtgcaccgaggactcggtgtgcaactggatgacccaccacgacgtgccgggctggatcgcccagagcggttacgtgatcgtggtcaaaccggtccggatcatcgcgatcatcgcgatcgccatgctgatccgctggctgctgcaccggatgatcacccggctcaccgccagcacctcccgggccgcgatgccggcgctgctcaagccgctgaaggagcggtccgacgtcaccgccgaggacgcacagttcatcccggagcgccgccggcagcgggccgaggcgatcggctcggtgctgcgcagcttcgtcagcgcggtggtcttcaccatggcggcgctgctggtgatgggcgagttcggcttcaacctgggcccgctgctggccagtgccgggatcgtcggggtggccctcggcttcggcgcgcagagcctggtcaaggatctgatcgccggcctgttcatgctgctggaggatcagtacggggtgggcgacacggtcgacctgggcgaggccaccggcgtggtggagagcgtcggcctgcggatcaccacggtccgcgactcgcgcggcgtgctgtggtacatccgcaacggcgagatcgtccgggtcggcaacaagagccagggctgggccatggtggtgatcgacattccgatcgggttcgtcaactcggaggaggcggtcgcggtgctcagcacggccgccgcggcggtggccgagcatccggagcaccagaccgagttcatcgagccgcccagcgtggtcggcgtcgagcagctgaccgtggacggcgccacgatccggacgatcgccaagaccaccgcggacagtcaggcgtccgtgcagcgggagctgcgccgggcgctggccgaggcgctggagagcagcgggatgtccgagcgcatcgccgcgtcccggctggccccgcggtccgcggtgccgccgcccgcctggtacacgacgcccggaaattcctcgtcttcgatcggtgaccagcggcccggcggaacggcctgacctgcgcttacgcgacccgattaggttacgccctccaccgaacggctaaaaatggggccaaccgccctagcctcccctagaacgatcgggcagaatccggaacagctcttgcatctgcacgagcacgttcacgccggtcgatggaggacatgtggccaacgatccggagggcccacagcacgccgcgaaggttacagaaggcgatcacccggtcaccttccgtagccttctcgcgctgcgggagttccgggcgatctacgcctcccaggtcatcagcgtgctcggcgacttcctgacccgcgccgcggtgaccgtcctggtctatcagcagacccactcggtgctgctgtcggcgttctcgttcgccgtggtctacctgccgaacatcctggtcggcccgctgctggccacgctcggcgaccgctacccgcaccggcgggtgatgatcgcctccgacctgttccggatggcgctgaccgcactgctgctgatccccggcctgcccaccgcgctgatcctgctggtggtgctggtggccagcctgggcacccccgccgggcaggcggcccgctccgcgctgtacccgctggcggtcggccgggaccgcctcaccctggcgctggtcacctccaacagcaccgtgcagatggcccaggtggtcggctacctgaccggcgcggcgctggcggtcggcctcggcccgcgggtcgccctcggcgtggacgtcgccaccttcgcggcctccgtgctgctggtcgccgccggggtgcagacccggcccggcgcgatcagcccggaacgtcgccgacacctgctgaccgagaccgccgagggtttccggctggtcttcgggcatccggtgctgcgcccgatcgcggtggtggtgctcaccaccgtcgccttcagcgtcgtgccggagggcctggccgcctcctgggccgccgaggccacccccaagggcatcccgcaggggatcgaacagggtctgatcatggcggccgcgccgctcggcttcgtcgccggcggcctgctgttcagccacctggtcccggtcgagcgacgctggcggctgctgccgatcctggccgtgctggttccgctgagcctggtgccggtgctgcccggcccgcagggcaccaccgtcgcggtgctgaccgctctgtgcgggatggcggccggcgccgccctgcccgccctgaacgccgcgttcgtcctggtcctgccgctcagccaccgggcccgcgcgttcggcgtgatgagcagcggggtgcaggccagccagttcctcgccgtgctggtcaccggcgtgctggcggaccacgtccggatcccgctggtggtcgcgtcgtggagcgccgtcggggcggtcgcggtcgccctgatcgggctccggtggccgagccgggaacgcttcgccgccgccgagcgggaggcggccgccgagcaggccacggcgccggtcccgcagcaaccgtcccggcccgcggggcaggccgaaccggccacctgagccgcggctggcaggatggtccggtgagctccttctacgacgaagtgggcggcgaacccacgttccgccgcctggtcgacaagttctacgagggcgtcgccgaggacccgctgctgcgcccgatgtatccggaggaggatctcggcccggccgccgaccggctgaccctcttcctgatgcagtactggggcggcccgaacacgtactcggccggccgcggccacccccggctgcggatgcggcacgcccccttcccggtcggcccggccgcccgggacgcctggttgacacacatgcgcaccgcggtcgactcgctggatctcgacgacgcgcaccgcacgaccctctggaactacctggagcacgcggcgaacttcatggtgaacacgatggatcccgtcgagccacctcgatgatcgtgacgcggccgccggtgactcgttgatcggttgtccgtccactcaccgggagccgccccatgcgtcgtcgcctgctggccgtcgccaccgttttcctcgccgcgctgggaggttccccgccgccggcggtggccgacatcacgcagtccggcatcgtctcggccaacccggtcgactggaccccgcacgtactcgacggcaccgtctgggcgctcgccgtcgtcggtgacacggtcatcgtcggcggcgccttcacccgggtcgccgacgccggccggcacaccaccctggcccgcaagaacatcttcgcgttcgacctgaacgacggcacgatccgctcgttcgccccggaggtcgacggcgcgatctactcgctcgcccccggcgccgacggcaccgtctacgccggtggcgcgttcaagaccgtgaacggcgcctcctcccgcgggctgacccggctctggctgggcagcggcaaccgggacaccggattccgcgcccacgtcaactggggcgacgtgcgggccctcgccacccgcggcgacgacctgtacgccggtggcaccttctccgcgatcaacggcaccgagcgggtcggcctggcccggatgaacgccgagtcgggcgcggtcgaccggggcttcgacgcccgcctgtccggccccggcctgagccgcgtccgggtcgagcacttcgacgtcaccgcggacggccgcaaactcgtcgcggtcggcgccttcctgcgggccggcagcgccgaccggacccagatcgccctcttcgacgtcggcggctccgcggcccagctcagcggctggtacaccgacgactacaagccgcagtgcatgaagggcttcgacacctacctgcggcaggtcaaattctcgccggacggctcctacttcgtggtcgccgcgaccgggcgggcctcctccgcccagaagctctgcgactcggcggcccgcttcgagaccaaccgcaccggcggccagcatccgacctgggtgcagcgcaccggcggcgactccctctacgcggtggcgatcaccgggccggccgtctacctgggcggacaccagcgctggttcgacaacccgtacggcaccgacggcaacggtccggggccgggggcggtctcccggccgggcatcggggcggtcagcccgatcaccgggagggcgctgtcctggaacccgacccgggcccgcggcgtcggcgtccgcgccttcctgacggtgccgcgcggcctgctggtcggctcggacaccgatcagctgggcaaggagtaccacggccggatcggcatgttcccgctcgactgacgatcgtgcagcggatgccgcggctcccgttcgggccgcggcatccgcgcgtgaaacgacacatcaacttcaagatcttgatgtcgtgcgctgcggccgacaactgatcgccgctcccgccgagggtccctgcgggcttcgctggccgctacgcgtccagaccgcgaagccctccggtcctacatccgcgggtggtcaccgagaaccaaccccgcgcctgccctccccgggcgcttccccgcatcctgccccacgtcgcagcccgcgaggcgtccgccagggcagcccatggcgcgcccgtcagatcagtccgcgcctgtcagcgcagctcacggggcagccgccagagcagccgacggcgcgcccgtcagatcagtccgcgcccgtcagcgcagctcacggggcagccgccagagcagccgacggcgcgcccgtcagatcagtccgcgcccgtcagcgcagctcacggggcagccgccggagcagcccacggcgcgcccgtcagagcagggcgccctcgtcgtggagccagtccacgaacgacgtggcgaccgcggcgccgcagtcgagcagctccaccagcagcgtgtcgtgggcgccggcggccagcggcacctgcagctcggcgtagatcggcagctgcccgcgctcggtcgcgtcccccacataggccttgcagaaccggcgggtgtggttccactcgttgaccacccggtaggcccggtcggcccagtccggcgggacggtcgcgtgcggacgggcccgcatcaccaggatctcgtcctccggaccctccagcgtgaacagcaccgcgtgccgctcccacatggccaggaggctgccaccgccgtcggcgaggaaccgaatgtcgagcaggtcgagggccttgccgatgcgggccagcgtgaccggctcgaccacctcggcggagccggagacggccgacagatcggacggggtcgcgccgcggccgagctcacggtcgggggtgcggctgagctcgcactcggggacacggtcgggggcggcgccgcgaccgggctcgcggtcggcgccgcggctcaggtcgttgtcggacggcaccccggtccggccgggctcgcgctgagccggaactccgacgcggacggtgctctgcaccgccacctcgccgccggtgtccggctcgttcgccgcggacgatcccggacgccatgaccaccaaggcatcgtgtgcacctcgctccccaacagacccgctgccggacgttgcagtagatccgagggccgacggtacccgtccgtttcctaatggtcatccccccaacgggaggccgaaaccagaagaacgatgtggcctcaccctttcgggtgactcgacatcggcataacggtcaatttgtgggcgctctgtcgccacgcgactccatatggtgccgaaattcccacccaggaccccgctgtgcgcacgcgggcgtccgccggctcggcgccgcgaggaccgagaaatcccattcgcgccaccgcctggacgagccgctgggacacctcgaccggacctgctccctccggggtgacgacaagcgcgacgtggtccaggagcgcgtcgcggaccgcccgctgcccgacggcgcgcccggcgaccccgcccgcggtcacctcgcgcagggtgccggcggccgcggcggccagccgggtcagttcggcgccggccaccgactcgaccgcggtgctcgcggccggcggcagcggccagcgccaccgggtgtcccggcgctccggcagctccgcgccgccggcggccagcacggccagcagctccgccgcggacaccgtggcgtcgcccggcccgggtcctgccacctcgcgggtgaccagcacgtcccacggcaggtgggcccagagcgcggtgcggccggcggtggagcgcagccgcaccggggcgcccgggtcgagccgggtcagccgagccaggaacgcgccggcgtccggcaccccgagcaggccgtgcccggacatcaggccacctcgacgtagggcttcaggaagtcgcgttcggcgtcggtcagccgccgcgggtgcccggcggccaggtgatagggcacgcacaccgatttcgcccggctggccagcacgccgtcgtcgaacagctcgtacgacacggtgaacgcggccgcccgcagctcggagatccacatttcgacgcggaccggctcgccgaagtccaccgggcgcagatagtcgatctcgtggcgggcgatcacgatgccctcctcgaacgagccgaggccgtggttgcgcgccccgacgaagaacatcgccacgcgcgcctcctcgtacagggtgaggaagcgcgcgttgttgacgtgcccgtacgcgtccatgtcggaccagcgcacgggcacgtcgtaggtgaatcgcctactcatgatcccacttcggtggtgacccgcggggccggctcagtcacgggtgagcttgcggtacgtcacccggtgcgggcgggccgcgtcggcgccgaggcggtcgatcttgttcttctcgtacgcctcgaagttgccctcgaaccagaaccacttgtccggctcctcgtcggtgccctcccacgcgagcatgtgggtggccacccggtcgaggaacatccggtcgtgggagatcaccacggcgcagccggggaactccagcagcgcgttctccaggctggacagcgtctccacgtccaggtcgttggtcggctcgtcgagcaggatcacgttgccgccgatcttcagcgtcatcgcgaggttgagccggttgcgctcaccaccggacaacaccttggtcggcttctgctggtccgggcccttgaagccgaaggccgccacgtacgcccgggagggcatctcgaccttaccgaccatcatgtggtcgaggccgtcggagaccacctcccacagcgtcttggtggggtcgagaccggcgcggctctgatcgacgtacgaaagcttgaccgtctcaccgatccgcaccgagccctcgtccggctgctccagcccgacgatggtcttgaacagcgtggtcttgccgacgccgttcgggccgatgatgccgacgatgccgttgcgcggcagcgagaacgacaggttgttgatcagcgtgcggccctcgaagcccttggtcaggccgttgacctcgatgacggtgttgcccaggcgcgggcccggcgggatctggatctcctcgaagtccagcttccgggtcttctccgcctcggcggccatctcctcgtaccggtcgagccgggacttcgacttggtctggcgggccttggcgttggagcgcacccactccagctcctcggtgaggcgcttcttcatcttggcgtccttgcggccctcgaccgccaggcgcgccgccttcttctccaggtacgtcgagtagttgccctcgtacccgatcgcccggccgcggtccagctccaggatccagccggccacgttgtccaggaagtaccggtcgtgggtgatcgccaggacggtacccgcgtacttggccaggtgctgctccagccagctcacgctctccgcgtcgaggtggttggtgggctcgtcgagcagcagcaggtcgggcgcctcgagcagcagcttgcacagcgcgacccggcggcgctcgccaccggagagctgggtgacgtcggcgtccggcggcgggcagcgcagcgcgtccatcgccagctcgagcttggagtcgacgtcccacgcgtcgaggtggtcgagctcctcctggagcttgcccatctcgtccatcagctcgtcggagtagtcggtcgccatctgctcggcgatcttgttgaaccggtccagcttggccttggtctcggcgaccgcctcctcgatgttgccgaggaccgtcttcgcgtcgttgagcggcggctcctgcgcgagcatgccgacggtgtagccgggcatcaaccgggcctcgccgttgctcgtcttgtcgagccccgccatgattttgagcaggctggacttaccggcgccgttcgggccgacgacaccgatcttggcgcccggcaggaagctcagcgtcacgttgtcgagcacgaccttgtcgccgtgcgccttgcgcgccttttccaggacgtagatgtactgggccacggtgtgccctacctccgagatcgtggatttctcatgccggaatcaaaaggcaatccttccaggtcggctcaccgtcgcctacgccaaccccgccggtcagtcgccgaccacccgctgttccgcctcggtcccgtccgacttggtgaccagcagccgctcccggttgatcgaaaaggtgttgccgtcctgcggcgcgaccgcctggaaactgccgtcgtcctgcctcgtcactccggccaaaaacagcgcggtgaccccctccttccacggcgcggcggtgccaccgcggttggcgtggtagaacagccgcccccggtcgtcctggcagatccagatcaccgtcttgcgctcggtggtgacgcggaacacctgcagcaggtcgccggtcgcgccgttgcggtgccccatctcctgggtctggtcggggcacaacccctcggtgggcagcaacgacggcccgtcggaggcgtcggtggtggccgaggcggagggcctggcggtgccccgggcgtcgcgacgctcgctgagcagatacccgccgatcatgccgatgatggtcagcaacaccgtggcgatcaccacaggaaagaagatcggccgccacggctgggaatgatcatcgaggggtgtcaccgggacaggatggcatccaagtcaagaccccgagagcagagtgggtacgttccttggtggctacgcacagtaggctcgctaggggaacagaaaccacccggaggtgtactcagcgtggcccaacgaagttccttcgtcgtcgtcgccaaccgtctgcccgttgacgaggtcaccctgcccagcggggagaagcagtggcggtccagtccgggaggcctggtcacggcgttgcatccggtgctcaccgagcatcgcggcacctggatcggatgggcgggcggcgacggaccggcgcccgagccgttcgatctcgagggcatccacatccacccggtgccgttgagcgccgacgagctggaacgttattacgagggtcagtcgaacgcgacgatctggccgctctaccacgacgcggtggagacgccggcctacaagcgccgctggcgcgactcgtaccgtacggtcaatcagcggttcgccgaggcggccgcggacgtcgcggccgagggcgccaccgtctgggtgcaggactaccagctccagctggtgcccgcgatgctccgggagatgcggcccgacctgcggatcggcttcttcctgcacatcccgttcccgccgatcgaactgttcatgcagatgccgttccgggccgagatcctgcgcggtctgctcggcgccgacctggtcggcttccagcagcgactggccgcgcagaacttcgtccggctggcccggcacctgctcggcctgcgctacgagggccagtcgatcctggtcgacggccggcgggtgaaggccggggcgttcccgatcagcatcgacacccgggacatggagcggctggccgccgacccggcggtgcaggcccgggccaagcagatccgcgccgagctgggcgatcccaagacggtcatcctcggcgtcgaccggctggattacaccaagggcatcgagctgcgcctcaaggccttccgcgagctgctggccgacgagaaactgcaggtcggcgacgcggtgatggtgcaggtcgcaacgccgagccgggagcgggtcgagcattaccagacgctgcgggtcaaggtcgagcgtgaggtcggccggatcaacggcgagttcggcaaggtcggcacgccggcggtgcactacctgcaccagtcggtcgacaagcaggagctcgccgcgatgtacgcggccgccgacgtgatgatggtgaccccgctgcgggacgggatgaacctggtcgcgaaggagtacatcgcctgccgcggtgacaccgggggcgccctggtgctcagcgagttcgccggcgcggccaccgagctgcgccagtcgttcctgtgcaacccgcacgacccggacggggtgaaggacgcgctgctgcgggcgatcaacgcggagccggccgagctcaagcggcggatgcgggtgatgcagcggcatctgcgcacccacgacgtcgcccggtgggcccgcacgttcctggacgaactcaccgtcgacgacgagagctgaggcgatctctccggcgccgggccgctgcggcccggcgccgatcatggagtggtacgtcgtctgccgccgccctctcgcctcagcgcggctcagccggctgccggggtgaacccggccgtcgcgctcaccacctcgccgatcaccacgaccgccgggggccggatgccggccgccgccacgtcctgcgcgaccgctcccagggtgctgcgcagggaccgctggtgcgcggtcgacccctcctggatcaccgcgaccggggtggccgcgtcccggccctcggcgatcagccggccggcgatcttcgccaggttcttcagccccatcagcaccaccagggtgccgcgcagccgggccagggcggcccagtcgaccagtgagtcggcgtgctccggcggaatgtgcccggagatgaccgtgaactcgtgcgccaccccgcggtgggtgaccggcacgccggccagtgcgggcgccgcgatcgagctggtcaccccgggcaccaccagcaccgggacgccggcctcggcgcaggccagggcctcctcaccgccgcggccgaagacgaagttgtcaccgcccttgagccggaccacgaatctgccctgcagtgcccggtcgaccaggatccggttgatctcctcctgggcggccgacggcccgtacgggatcttggcggcgtcgatcagctcgacctccggccgcagctcgcccagcagcatcccggggaccagccggtcggcgaccaccacgtcggcggcggccagcaggcggcggcccttcaccgtgatcagctccgggtcgcccggcccggcgccgaccagcgcgacgcccttgagctcgggggcgaccgggggtgccgcctccagcgcgtgcgccaccaggtcacggaccgccatggcccgccgccggtcaccaccgtcggtcaccgcgacggtcacctggccgtgccgggtgacggcgggcgtccaggcggtcgcggcgtcccggtcgtcggcgcggacgcagaagatccggtgttcctcggccgcgtcgctgacctgcgcggccgcctccgggtcgtcgaccgcgacgtggaccagccaggcgccggccacgtcggccggctcgaagcgccgcggtgtccagcgggcccggccggcgtcgacgtacgcctgcagcgccggggtgagcaccggcgagacgatgtcgacccgggcgccggccgcgatcagcgcgggcacccggcgggtggcgaccgagccgccgccgaccaccagcacgcgacggccctccagccggagggcgaggggatagaggctcatgtcgtctcctgggctcttccggtcacggtgcggccggtcacttctctgagacccccgccgaatcgaacgtggcgacctcgtgcagaacccggaccgcggccgcgacgatcggtagggccagcaccgcgccgctaccctcgccgaggcgcatcccgaggtcgatcagcggctccaggcccaggtgggacagggcgacggtggcacccggctcggccgaacggtgcccggcgaccatcgcggcgaccgcgtccggggcgaacgcggcggcggccagcgcggccgaggcggcgatcaccccgtccacgatcaccggcacccgggcggcggccgcgccgaggatgaaaccggtcagcgcggcgtgctccaggccgccgaccgtggccagtgcgccgagcgggtcggccgggtccggggtgtgccgggccagcgcggccgcgatcacctcggtcttgcgggccagggtggcgtcgtcgatgccggtgccgcgcccggtcaccacggccggcgcgctgccggtgaagaccgcgatcagggccgcggcgggcgtcgtgttggcgatccccatgtcaccggtgagcaggcatcgcgcaccggcggcgacgagctgggcggcgaccgcggcgccgagctcgacggcggcccgggcctcctcgcgggtcagcgccggctcgacggtcatgtcccgggtgccgcgccggatgttggcgtccagcaggttgggcccgccgtgcagcgggatcttcaccccggcgtcgaccaccatcacgtccgcgccggcctgccgggcgaacgcgttgaccaccgcgccgccggccacgaagttcgccaccatctgcgcggtgacctcctgcggccacggggtgacaccctgcgcgtgcacgccgtggtcgccggcgaagaccgcgacggtggccggcgcgggcagcggcggcgggcagaccccggccagcccggccaggcgcaccgacagctcctccagcgcgcccagtgagccggccggcttggtcagccgggactgcagctcgcgagcggcggccatggcccgctcgtcggccgggcggatggccgccagggtggtctccagggtcacggtcgctcctcgctcacatcgccgatcacttctcgcagagtctgcacgaatcggtccgtggtggcagtgtcgcgcaccgctatccggagccagtcggggcccaggcccgggaaggtgtcgccgcggcgcaccgcgtagccacgttcccgcaggtgggtgcgtatccgatcggccccgggcaggcgtacggcaacaaaagcggacgccggatgaccggcgaccgtgaccttcggcacctcccgcagccgttccaccaggtgggcccgctcggccgcgagcgcggccgcgatctcgcgctcggcggcgaccgcgatcggcgaggcacaggccgatgccgccgccagcgccggcgtggagaccgcccagagcggctgcgccgcggcgagccggggcagcagggcggccggacccagcaggtagccgatccgcagaccggccaggccccaggtcttggtcaggctgcgcagcactaccagcccgggcaggtcgcgacgctcggtcaacgattccggttcgccgggacgatcgtcgcggtacgtggtgtcggcgaacgcctcgtcgaccaccagcacgcgaccgggccgggccagcctcgccacgtccgcggccgggtgcagcaccgaggtcgggttggtgggattgccgacgaagaccaggtcggcgtcgtccgggaccagccccgggtcgaggcagaagccgtccgcctcgcgcagcagcacccgctcgacggtgtgcccggcgttgcgcagcgccgcctccggctcggtgaactgcgggtgcaccacgaccggccggcgggccccgcgcagcgcctgggcgagcagcacgaaaccctgcgcggcccccgcggtgagcagcacctcggccgggtcacgccggtgccgggcggcgatcgcggcggtcgcggcggtggcgtccggataggcggacagccgggtcagcgcctcccggatcgggtcggcgagccagtccggcatcgcctggtggcgcacgttgaccgcgagatcgatcaggccgtcgcccacctccgcgtcgccgtgatgatcaaggtcgtgggtcaccgggacagcatgccgcacccgtgttctcccgcggattcctggggaacatgaggcgatttgtcataccttcgaagggtgactgaccgacgccccaccgtagccggaagagtcgccctcctgatccgtgccgggctgatcgcgggcctggtcatcgccggcctctcctatccgttcacggcattggccgggatgggcgtcaaagccggcaccgacgccctggacaacatgccggagcagctcaccgaggtgcccgcggcgcagaccacctacgtgtacgccaaagacggcaagaccctgctgaccatgttctacgaggaataccggcgtcaggtgccgctcaaggacatgtcgccctacatcacccaggccatcgtggcctccgaggacacccgcttctacgagcatcacggggtcgacgcgaagggcgtggcccgcgcgttcgtcgccaaccagcaggccggcggcgtctcgcagggcgcgtcgacgctgaccatgcagtacgtccggatggccctgcgggacagcgcgaaaaccccgaaggaggcactggaggccaccgagcagaccgcggcccgcaaactgcgcgagatgcggctcgccgtcgaggtcgagcagcggctcagcaagcaggagatcctgcagcggtacctgaacgccgcctacttcgggcaccgggcgtacggcatctacgcggcctccgaggtgttcttctcgaagccggcgaaagacctcaccctcaacgaggcggcactgctggccgggttggtcaaggcgccgtccgcgtacgacccggcgaccagggaccaggacgccgccctgcaacggcgcaactacgtggtcgaccagatgctgaagatgggctcgatcaccgaggcgcaggccaccgccgccaagaaagccaagatcaaacttcggttgagtacgccgccgaacgactgcgtgtcggtctccgacgagcacaacgactggggcttcttctgcgactacttcaagaactggtggcgggaacagcccgcgttcggccgcaacgtcctggaacgggaggagaacctgcgccgcggcggctaccgggtggtcaccacgatcgacccggccgtgcagggctacgcgatcagacacgtgctggacaaggaggggcgcaacagcccgttcgcgcacggcgaagtggtgatcgagcccggcaccgggcgggtggtcagcatggcggtgaaccgccggtactcgctgcagcaggacaacaacggcaagcacagcgaccggaaccagcgggacgtccgcggcaactatccgaacacggtgaacccgctgctcggcggcggcgacatggccggctaccaggccggctccaccttcaagatcttcacgctgctggccgcactggacgccgggctgccgctctccacgtcctactacgccccggaacggttcgtctccaaatacatcaccgcgcccggcccggcgacgtgcggcacgcactggtgcccgaagaactccagcaagtcgatgaccggcgaacagaccatgtggagcggtttcggcaaatccgtcaacacctacttcgtccagctggaacagcgggtcggcgcggagaaggcggtggcgatggccgaaaagctcggcctgaagtggcgcaccgcggtcgaccgcaccctggccacaccggaacacgccgccgggtggggcgcgttcaccctcggcgtcagcgacgccaccccggtcgagatcgccaacgtgttcgccacggtcgccgccgaaggcaactactgcgagccgctcccggtcatctcgatccgcacgccggacggccgggacgtcacctccaggggccggaaggtcgccgatccccgctgccaccgtgtcttcagccgggacgtggcccgcgccgccaccgacgcggcccgctgccccaccggttacggcgccgcccgcggcagctgcggcggctggggcacgtccgagatggtgtacgccaccatgggccggccggtcgccggcaagagcggcaccacggacaacaacaagaccgcctggttcagcggcttcaccccgcagctggccgcctccgcgttcgtcgccgacccggacaacccggagcattacgtcggctcgggccgctccaccatctcgaaatacacggtcgcggaaacgttgcgggacgccctcaagggccggcccgaactcgacttcaccccaccgtccgacaaactcgtctggtagccccaccggccaccaacccgacccgctcccaccagggccgccgccacccggcggcggccctgcccatccccgccgacatgccgcgccgtcgccatcccggcactgccccgcagcccgcgccgcatcgcatcgccaggcccggcggtcccgcccgcaccacgccggccccgccggtcttgcgccgaccgcagcggccccgcctgttccgcctgccccgcaggctgaacaacgccgcggcccaactgcccgaccgcgcgccgatgtcgggctcgcctcgcgctcttccctcgcccctgtcgggcgcggcggcttgcgggtcctccggtcaggcggagcgggggcagaaagctccggtcaggccggacgggcggcggggggctggtcgtggcggaggcgggccgtggggacgtcgcgcatccggggtggccgccaggacggatcgcggccggcgagggcgagggcgcggggcaggtcgtcgtcatccgacgggtcgatcgggactcgtgggccgaggaagcccggggtaccctccggcgggccggccgagaggaacgtgatcagcgtggccaggacgcgcggatcggccgcgaagtcctgcccggtggcgcgtgccaggtcccagccgtgcatgaccagctcgttggcggcgaccgtgcccagctcggcggcgggcatggtgaccccgccggcccgggccgtgccgcgccaggcggacgggtcatgccacgccgtggcgagctcctccagcagcaccggcaggcggctgcgccagtgcggggacagatgctcggcggacggcgccgggggcgggccggtcccggacgcgtcagcgcccttgtgcgcggcgtcggtgaacgcctcggccagccgcatcagatgatcgaggagggtcgcgacggaccagccggggcagggtgtcgcagcggccaactcgcggtcgtcgacccccagcagcagagctttgagccgacgaaccggcgggtccagatccagcggcaggcgagcggccacggcgttctccttcggttgtcgtgcccctcacgttacgagggaggtacgacagtttccggaccgtcgcccgccgttttcgcacgctgggccgcttccggcggccgatcccggcggaccggccgcgtgggtcaggaggagatcgggatgtccgacgtcggacgggtgtccggcacaccgcccgggccctgggccgggccggaaccgggcgccccgggagcggagtcgccggacgtccggtggatcgggccgccggcagcccccaggaccgggacggccccggacgctccgtggaccgggccggcgttgggcgaccccggtcccgtccgcggcacgatctgcccgttcgcgccggtcaccccatgaccgggaccgttgtgcccgctaccgccggtcactccgggacctggaccgttctgcccgttcacgccgtgcggaccgggaacaccggggccggcaccgttgagcccggacccgccgtggccggcaccgttcgacggcgccatgccctggcccgcgccgttcggcgccctgcctgcggccgctgcggccgggtaggactgcccgtgatacggaccggccggacccatgccggctccggaaccgtcgggcctgcccaggccggggatcggcccggtggcaagggtcaggtccagcgtcggcccggagggcggcatgcccggggaggcccccgctgcggatgcaccggccgagtggtgcgcggaatcgccgggcctggacggccgctggccgccgctcagcggggagtgggaaccgggccccgggacggagccgggcatctgcggtccggccgcagccatcgacgagtgctgaacgggcatcggggaccccggcccggaaggcgcaggcccgtacccacccggctgcggggacgacgccgaagccggcgacccgtgcccggcggtctgcggggacgccacggcgggcccagcctagctagctagcggcgagccatgcccgcccggctgctgcgggcccggccccgcggatggcgccccgtgcccgaccgccggcgcgtggctcgacgacggaccgtggctggaagaggcgtggcccgacgacggaccgtggcccgaagaggcgtggccggccggctgcggcatcgggctgccggactgcggcccgtggccggacggctggtggcccggcccgcccggcttgaccggtcccgcgatcgcggctgccaccaggcgtttcgcgatttccggggcggctgcccagtgcaggcccagctgggaggcgtggatctgacgccagacgaagccctccgggttgccgcccgaccaggtccacgccggggtggcaccggcgcgcggcgcgaccacagcgcggtgctgcttgtatccggtgatccgggcgccggccggggcgaggaccgagctggccggggcggtggcctcccgatagccggcgacggtctgctcgccggtggtgccggtgatgtccagcaccccgcacatcgggcggccgtccaggtcacggccgagccagggcagcgccaccccctcggcgatcaccggccagccgtcgcgggcgaattgcgccacgtcggcacagaggtgacggttggcggagagttcctcggcgtacccctcaggaagaccggaaccgacgatcaacgcccgcgtgcccggcggcagcgactcgtcgcggagcgggtccacgacgatcacgtcggcgcccgcggcggtcagcagctcggcggtctcgacgtacgtgtagggggcgcccggaccacccgcgagggcgatcaccggccgcatgtcggcgggctcgccggccgcctcggccggcgtccagagcgggcccggcaccggcggggccgcgttggccagcgccatcagccggtccaggtcgagtgactgggcgaccgcctcaccgagccggcgcacggcgcgaccggcctcgaccgtgcggtgcgcgaccgggaccagcccgtgcgcgcgcgacggcagcacgttgggcaggtcgccgcggcgcagcgcaccgagcaccggcatgccgatgtcgtccagggcgctgcgcagcatctgctcgtggcgcggcgaggcgacccggttgaggatgacgccgcccaggtggaccatctcgtcgaacatccggaacccgtgcaccatcgcggccagcgagtgccccatcgcggccacgtcgaccaccagggcgaccggggcgcgcagcgcggcggcgaccgcggcggtgccgtcgatctccggctgaccggtgagactgtcgaacaggcccatggcgccctcgatcaccgacagctgggccccggcggcaccgtgcccgaacagcggcgcgatccgctgcgcgccgaccagccgcgggtccaggttgcggccggggcgtccggccgccaatccgaggtacgccgcatcggtgtgatccgggccgaccttgaaacccgccgtcggcagcccgcgggcggccatcgcggcgagcagaccgacggctatcgcggtcttgccgtggccggatgacggcgcgctcacgaccagacggggctgggcggtgatcaatgtttcccccgagggtttcgcggaccggcggtcacgtgctattggccgccggaagttcgcacagtacccggctgcggcggaggctaccgcctcgccgggtagcctcggggggtgtaccggttcctgctgacaccccgctggctggccaccgccgtcctcgccgtggtcgcctcggtgatcatggtgatgctcggcaactggcagctccgccggtatcacgagcgcagcgagatcaacgcccggatcgacgcggcggactcgacgccggccgtgccgatgacgtcgaagctcgccgcacccaccgtgcagggcaccccgggcgcctcccccggcaaggctgtggcctggacaaaggttaccgtcaccggccgctacgacccggcgcacgagatccaggcccggggtcgcacggtcaacggcgacgtggggttcgagatcgtcaccccgctgatgctggccgacggcacggccgtgctggtcgaccgcggctgggtgccgccggcggccgccggagcgctcgctcccccgcaggcgccgcccgcacccaccggccaggtgaccgttgtcggacaggttcacctgtcggaaagtcgacctgccccgatcgagcgacgtgacggccggtgggacacccgccggatcaacgtgccccggctcgcgcacgagctgccatttcccgtgtacggggcgtatgtgctgctgacctcccagacgccggccaacgatccggccttcgcggcggtcccgatcgatcacgaggacgcctggcagaacggtggctacgccgtccagtggtggttgttctcggtcatggcccttgccctgtggggctatcaggcgcgccgggaggcgcacggcgtcaacgccccggccggcgaacgccccgagccggccggcgaaccggtggcgtcccccgcgccccgcacccgggaccgcgtcgcggaggtcgaggcccgccgcgcgaagaaggaccgcccccgcgaccgcgtcgacgacgccgaccaacgccgcgcgagcaaggaccgcccccgcgaccgcgtcgacgtcgccgaccgacgccgcgcgagcaaggaccgcccccgcgaccgggtcgaggaggccgacctgcgggccgccgcggggaaggccgcggaaccggtcgatcgggtcgaggaggcggaccgtcgcctcgcggcgcagaacggcgccgattaatgtccgggtcatgaccttcccgccggacgacccctggggcacccccacgccggccccggccgggcccccgccgactccgcccgtgccgcggccgcagcccgcgtcgccgtatgagccgccccggcagagcggcccggtcatcgtgcagatcgccgagatcgaggtcacctcgtcgacgatccgcaccccggccggcgacttcccgctggccggttcccgctggcaggtcaatgagttctgggtgaccttgcgccgcaccccgctctgggccaagatcgtcggcttcgccggcatgtgtttcacgttcggcctgagcctgctgctgttgctggtcaaggagacggcgccgcagggcaccgtgcaggtcaccgtcaccagcggcccccagcagtacgtcgcgcggatcgccgtcaacgacgagcaggacgtgatcacgatcaatcagcaggtcaactacgtgcggagcctgtccgccctgtgaggccggtgtgccgccctcatccgcgcagatctccgccgccggcggcgaccccgttcaggaggtcacggcgccgcccccgatcgcccggaccgcgtcgatggtgtccgcctcggcggccggcttgtcgtcgcgataacgcagcacccgggcgaagcgcagcgcgaccccgcccggatagcgcggcgacgtctgcaccccgtcgaacgcgatctcgaccacctgctccggccggacccgcaccacccagccgttgtcgtcgaccgcgagttccttgaaccgttcggtctgccagcgcaacagctcgtcggtgaggcccttgaacgtcttgcccagcatgacgaacccgccggtctccggatcccgggcgcccagatgcaggttggacagccagccgcggcgccgcccgtgtccccactcgacggccagcaccaccaggtccagggtgtgccggggcttcaccttcacccaggcggagccgcggcggcccacgtcgtacggcgcgtcgggagccttgaccacgacgccctcctgtccggcggccagggcggcggcgaacgcggcggccccctgctcctgcgtctccacggtctgccggccgacgatcagccccgccggcagtgcgtcggccagcgcggcccagcgcacccggccgggctcgtccagcagatcggtgccgtccaggtgcagcaggtcgaagaagtacggcaccagcacggccgcggcgtcggtcccgcccgtcttcgcccgggtggcggcgcggctcgacgtctcctggaacgggcggggccggccctgctcgtcgagcgccatcgcctcgccgtcgagcaccacctcgcgcagcggcaacgcccgggccgcggcgaccacgccgggcaggcgttcggtgatgtcgtccaggctgcgggtgaagacggccacctcgtcgccggagcggtgcacctggatgcggatgccgtcgagcttggtgtcgaccaccgccggggtgccggtggccagcagagcggcggcgatgtccggcgcgctctgcgcgagcatcggggtgagcggtgtgcccacccgcaagctgatcgcggcgagcgcggccgctcccccggtcagggccgcggccgcgacctgcttcagatcgccggacaggagcagggcgcggcgtacgccggtgaccggcaccgccgcggccaccgcgatcgcctcggtcagcagcccggcctgcgcgccctggcgcagctccccgctgaacagcccggtcagcagccgctgctcgtccgcggtcgccgcgccgaacagcgcgccgagcagctgccgccgccgcgcctgggagcccgctcccgcgaccgtggcgatctcggcgatcgacgcgtccacgccggcgacggtcagcgtcggctccagcgccggggccggccgctctcgcaggccggcgtagccgacaccggtctgccgctgccgcagctccccggcgagatacgcggaaccggccgcgatctcgtccggctccagccgccgcagcgcgtgcgcgagcagctcgatcttcgctttccgcccgccggtcgccgcaaccgccgccgacgtggccgcaatgtcaagaaaccgcacgatccccatcctggcagcccacccggccgcccgccgcggcgaagccggccatttccccaaccttggccgccacccatcgatcccggcaccgccgacccaccccggcacaaccggcctaccccggcgcaaccggcctaccccggcacaaccggcctaccccggcacaaccggcctaccccggcacaaccggcctaccccggcacaaccggcctaccccggcggcgcccggccatgcggcgccatccggcagctagccggcggcactccgctatccgccgctgccggcccaccccgccgccacccggctgtccggcgctgctcgccaactccaacgccacccgcctacgcggcgcgctgctcgtctattcggaaacctcgggcgcggaccgcctctgcaacccgggtcagctcggtgtcgatgccacacagtgcctgggagagctcgtcgagatgctcggtgagggtggcgtcgtcccacccggagacgtcgacgtcccccagagcccggaccgcggcacgcagccgcgcgatcgactcgatccgatcgcgagtccgaagccgatccagagtggcgcgtggcccggcgggcttgggccgggtcacgctgccgttcggaacagcacctatcgaacgcatgttcgaatcctatcaggacccgccgtcgatcacaccgccaaggcgtgtcggaaagtcacctccgcctcggccggcgtggcgcggcccgcgacgaagccgtccgggcggaccagatagaacaagccgggctgtagcggggtggccggtgcggccgggaagacgtgcaccgggaggccgagatccggggcctcggtgccctcgacgccgccgtacccgtggatctgccaatcggcggtgcgcagcacggcgaagttcgctccggtccacggcaggcggcggccgacgaccgggtcccgtttgccgtccggggtgcgcgcctgcggaccgatcggatagtggatgcgggtctgtgagacgtactggaacagtcgggacccgccggaggtccgcggcagcgcgcgggccgccatcggggcgatcagcgggatcatggcggtccgcaccacccggctcagcgtgcgctgcgaggtgatcgcctggaagagccggtcggtggtggccaccagcgtcttggcgaccgggcggcgctccgcctcgtaccggtcgagccaggtgtcccggcggcggccgcgcagcacgtcggcgagtttgaaggccaggttgtgggcgtcctgcagaccggtgttcatgccctgcgcaccgatcggcgagtggacgtgcccggcgtcccccgccagcaggaacgggccgtcccggaaggcggcggcgacccggtgatgcacccggtacgtcgcgaaccagcgcgcctcggtgtaggtgaccgcgaacaactcccgcagccggccgcgcacgtcgtcctcgtcgagcgcggagtcgccgtcgacgtcccggacgatgccgatcagccgccagttgtcccggccgggcatcgggaaggcgagcaggaagtcccgcccgcccggccgcacgttgaccgcgccgccgaccagaccggccgccgcggccgcatccagcacgtagaaccgatgcgcgttggtgctgccctcgaacgcgatccggcgagccttgcggaccgccgagttggccccgtcgcagccgacgcagaaccgggcctggacggtgtggttgccgaccttcgcctcgagtcccctctcgacctgggtgaccgcggtgaccggggtctcccagatcacgtcaccgccgagcttgcgcaggtggtcgtagaggatctcctcgttgcggctctgttcgaggacctcgaggaacgggtacggcgtggtgccgcgcccgagcgccccgagcggcacccggccgaacacccgggagccgctgccgggcgagatcgcctccgcccggttcgccgcgtcgaggatctggtcgccgatgccgagctggtcgtagatctccaggctgcgcgcctgcaccacgagggcccgggactcgcgggtcggaccgtccttgccgtccaccacgagcacctgcaccccgagccgggtcagccagttggcgagcatcagcccggtcgggccggcgcccaccacgaggacctcacacgacagctcggtcatcagcgactccgtcctagctcacttcgtcaggttctccgcaacgttcttgagcagcagcacctcggcgaggcagacccgctcgaactcgcccaggtgcaggctctcgttcggcccgtgcgcggcggagtgcgggtcctcgacaccggttaccaggatcgtggcatccgggaacagctcctggaaggtggcgatgaacggaatcgatccaccgacacccatgtcgaccggctcggtgccgtcccacgcggaccggaacgcggaacgggcggcgtcgaaaccggggccggtcgcgtcgatcacgcaggggtcgccgtcgctctccagggtcacctcgacgtgcgcgccccacggcacgtgcttctccaggtggctcttgaccgcggcgtacaccgatttcgggtcgtcacccggagcgacccggacgctgaccttggccttcgccgaggcctgcagcgcgttggccgcctccagggtgcgtggcgcgtcgatgccgagcaccgagatggacggcttggtccagatccggtcggtgatcgtgccgcggccgatcagggtgacgccgtcgagcatgccggcctcgtgccggaaccggtcctgcgggtagtcgacgctggcgccctcccggccgaccagaccgtcgaccgcgacctcgccgtcgtcgtcgtgcagcgagctgagcaggcgggacagggtgatcagcgcgtccggaacggcgccgccgaacatgccgctgtgcaccgcaccgcgcagcacctcgacctcgacgaacaggttgaccaggccgcgcagtgaggtggtcagcgcgggctggccgatgtcccagttgccggagtcggcgatcacgatcacgtccgagcgcagctcgtcacggtgggcctgaatgatcgcgtcgagcgagtccgagccgtactcctcctcgccctcgacgaagacgaccacgccgaccggcagccggtcaccgaacgcgcgcagcgcggccacgtgagccatcaccccggccttgtcgtcggcggcgccgcggccgtagagccggccgtcccgctcgaccggctcgaacgggtcgctcgtccacagctcggggtcaccggccggctggacgtcgtggtgggcgtagagcagcaccgtcggggcgccgggcggggcgggcttgcggccgatcaccgcgggctggccgccgtgccgcacgatctgcgtgtcgaggccacagccgcgcagcagatcggcgaccgcctcggcggaacgctccacgtgtgaatggtcgaaaccctcgaaagcgacgcccgggatccgcaccaaccgttcgaggtcggcgcggacaccgggcatctgctgcgcgattgtggcgcgcagttcggattcagtcaggctcatcgcccgatcgtaatcagctcgcttcgccgtcgccgccgttgccgtcgccccgggcccggcgccgggcgtcgctcgcccagttcatcgcccggccggcagccgcgccggccatgtcggtcgcaccgtcgccgacccggcgcagcagcccgaccagcggatcctgcgaattggcgaagtcctcccggtacgactgggccgccgccttggcgtccgcgctgaacgacgagtcaccatccgagtcacggtgcgggtagtcgccgctgaggatctgcgcgtacgcccccgagtcgatccacttgcgcagctcggcggcgcgggcgaccgggaacggatgcgtgctccaggcggtcatgcccagtttgtggatgctgtcgcggatgtcgccgccaccctcgtactccgcggcctgctccaggaacgcggtggtgtcgatctgcgacaggtcaccgccacccgccagtttcatcagcagccgcagcgaggcggacgggtcctggccggcgagcaggccggcccggtcggcggagagctccgccttgcgccaccactccagcatccccgcgatgatcgcccgcagcgcgatcgccccgaccgggacccagctgatgttcgccgcccagttggtcaggatcatcatgatggtcttgtagacggcgtggccgctgcgcacgtgccccagttcgtgcccgagcacggcccgcagctcgtcgtcgtccagcttctccaccgcgcccgtggtgatcacgatgaacgggcggtccagcccgatcgccgagccgttgatcatcggcgactgggtcacgtagagctcgggcagctcggcgatgtccaacgtgctcgcggcctcggtgaagcgctggtagacccgcggatactgccggtggtcgacgcggatcgagccggccaggtagctcagccggaaaccgcgctcgttccacatcccgaagaacgtcttcaccacgtcgtcgaaaccgcgcaactcacgcagagcggacagggccccccgatcggccgggtgctcccaggcccgggaactgatcccggtcagcgtcacccggcggcgcaccgggcggttctcctcgtcggtggtcatcgatcacaccccgtcctcgtggcacacactggcccgcgcggcgactgccgcgccggacccaacgtacgcccggaacgcaacggtgtcgtcagggtccgacccctacggggcgcccggcggcacgaacggcatcccaggtggcgggccgttttccagcagccgccagagcgccgcggtgtccaggtgctcggccaccaggtcaccgagcacgtccagggcccgggcgcggatcgccgcataccgggtgtccggggcgaccgtgaagccgtgccgccccgcctgggcggcggccgcggtcaggaatcggcggcggaactcgtcggactcgaacgtgccgtgccagtgcgtgccatacacgtttgcgcgtaccgcaccctcgggccggccatcggcgtaccgcagaaacgcctcgggagcctcccgggtgacctgcccatggtggatctcgtaaccacccaccggcgccccgagcgcggacccggcgctgcgggccagcgtcttgcgggccgcgaaagtgacctccaccggcagcaggcccagccccggcgtgacgccgcgcccactctccacctcgtcgtcgatcgtcccggccagcatctggaacccgccgcagactccgaccagcggcttgcccgccgcggcgtgcgcggtcaccgcgtccgccagcccggtctcgcgcagccaggccagatcgctgacggtcgccttggaaccgggcagcatcaccagatcggcgtcggccacatcgcccggctcgacggtcagatgcacccgcacgcccggttcggcggcgagcgcctcggcgtcggtcgcattcgagatccgcggcaggcggatcaccgcgacccgcagccactcccggccgtgcggcgggcccggtcggcccagcacggtgccgtaggctagcgaatcctcggcgtccagccagacgtcgcggtggaacggcagcacaccgtgcaccgggcggccggtgaccgcggtgatcatgtcgatgcccggctggagcaggcccaggtcgccgcggaacttgttgatgacgaagccggagaccagcgcctggtcctcgggcgagagcagggccagcgtgccgaagaacgcggcgaacaccccgccccggtcgatgtcgccgaccaccagcgccggcatgccgaaccggcgggccagacccatgttgacgaaatcgccgtcccgcaggttgatctcggcggggctgccggcgccctcacagatcaccgcgtcgaagtcggcacgaaggtcggtcagggtggcgtacgccgtctcggcaagcttgggccgcagcgaccggtagttgccggcggtgaccgtgtcgatcgcctcgccgagcaggatcacctggctggaacggtcactgcccggcttcagcaggaccgggttgaagcggaggtcggggggcaggccgcaggcctcggcctgcatggcctgggcgcggccgatctcgccgccgcggccgtccggggccacgacgacgaccgagttgttggacatgttctgggctttgaacggggcgacccggacgccgttgcggtgcagccagcggcagatcccggcggtgaggatgctcttgccggcgtccgaggtggtgcccgcgatcagcagcgtgttcgcctgacggccccgttggggccccgcccccgcccccaccgccaccaccggatcgctcatcgggatccgtcccgcccggcgcgccgcagcgccgccccgaaaccacctctgaccagcgcaccaccggcggcgagcagcatcgccgccgctcccaccgccgctgacacccgcgccgcacgccgcagatgtacggcggacggccgcggcccgtcaccgaggaacggccgggtctcgctgcgtccgaaatagacgtttcgcccacccaggcgcacccccagtgctccggccatcgcggactcgcactgccccgcgttcggcgacggatgatccccccgatcgcgccgccacacccgagccgtctcccgcggcgtgcccccgccgatcggcgccatcgcgatggtcagaagaccggtcaaccgcgaaggaccgagattgagtacgtcgtcgagccgcgccgccgccgtcccgaagcgggcgtagcgggcggaccggtgccccaccatcgcgtccagcgtgttcgccgcccgatagccgagcagcccggccggcccgagggcggctccccagagcaggggggccaccaccgcgtcggaggtgttctcggcgaccgattcgaccgtggcccgggcgagttcggtctcgtccagcgcggacgggtcacggccgcacaggtggccgagccgcccgcgggccgccaccaggtcgcccgcggtcaggtgtcgggccatcgtccgggattctctgcgcagtgtgcggccgccgagcacggtccaggtcgcggccgtggtgagggcgaaccgggcggccggcaggtggcgggtggcccgcccggcggccagccccgccagcaccggcacgccgacggccaccgtggtgaacaggacgcccgcccggcggtcgggacggtagacccgtctttccagggcggccgccgcggtgccgtagccggcgaccgggtggaagcggcgcgggtcgccgagcgcggcgtccagcaggtatccggcgatcagcccggccgcgtccgcggtccaccggttgagcacgtggttcctttcgcttgatgcgtgacgctcccggtcagcctgattcttcggtcagcctgacccgctcggtcggcgtggcggtcagcggccgaagggcgtcagatcgaacgcccagaccgccagcgcggccggaccggcctcctccgggtagggcaccggttcgagggcgccccactggatcgagccgggggcgcggtcgaccaggaattccaccacgatggcgtgcaggtcatcggtcacctggtaggtgaccgggaagaccagatcgcccggtttgcgggtgctgaccgagcagcgcagctggcctgcttccgggtcatgccagacgaagaacgtggcggtgccgcggtggccggagccggccacctgttcccgcagcgcggccgcggtctcctcgaaggcggtcaccacctcgtcgggcgacatgcccatgcgttcgtgcggtggcgcgccgaaccacgtggtgttgacgtattcggcgtcctgatcctcgggcgttagcaccatcgtctcttcggcgacggcgcggatgtccttcagcatcaccacttcagtctgccggttgtggttgtcctgagaccaatcgggccgctccgcctggcggccgggagaagcggaccgatcggcccatcccgatcgagggaatcgggttttgtcgacgagatcgtcacgtgcgggtttcccgcaccggcggcccggcctcggacccctttccggccgggccgccgggcgccacacaccgcaccggacgcagggaggcccggcgggcggcggcggtgcgggaaggtctcaggcggggaccggctcgcgcctgacccgccgggtgcgacggacctcggtggtcaccgggtcggccggcggctcctcgccgggctcctcggtgggctcgtcggtggggtcggtcaggccggccaccacttcgaggaagtccggctcggtctcgccgggcagcggctcgggaaggccttcgccgaagcggaccgggacctgcccgtcggtgaccgggtcggcgggctcgccgccgaccatggtctcggcctcggtgtcctcgaccacggcgagcgcggcgagcgcccgggtgcggtagaagcgggcccggccgcgggacaggtcgaggccgacggcgagcgcttccagctcgtaggcgacccgcgggttggactcgtcgtcggtccagtcccgggtgtagatgcggccgtacacgatgaccgggtcgccgacccggatggaggcggccaccccttcggcgaggcgccgccacgcggagacccggatccgcagggtgtcgccgtcgacccagcggttgttgtcccggtcgtaccggcgggaggtggcggcgacccggaagttggccacgagctggccgctggtgttggtgcggcgccattcgggtgcggtcagcacgttgccgacgatggtggtgtaggtgtcgttcatcgttgtctccttgacgtcgattgccgcggacgtgatgagactggcgggtgcggcgcctcggcggggatctgcctgtggacggcgcgggagtgtggacaacagccggcggcgtggtggatctgatatggcgcgccgcggcgtactcatgggtaacctgtggtggtggagatcgacgtcctgggccggccgtatgagcggcacaccatcgagctgggcgccgacgacgagggcccggtcgtggccactctcgtccggcggcgcgccgagcaaccgacccgccgggcggtgctgcacgtccacgggttcgtggactacttcttccagacccatctggccgacttcttcgtcgagcgcggctgggatttctacgccctcgacctgcggaagtacggtcgtagcctgctgccgcaccagacgccgaacttcgcgcggagcatgaccgactacttcccggagctggacgaggcggtccggatcatccgcgagcaggacggccacgaccagttgctggtcagcgctcactccaccggcgggctgatcacctcgttgtgggcgcacacgcggcgtggccggggtctcgtcgacggcctgttcctgaacagcccgttcttcgagttcaatctgccctgggtgatgcgccggccggcgttgtccctggtcgtcgcgatctccgggcgcaccccttaccggattctgccgaccgccgggctgggcctctacggacagagcattcatcaggaccatcacggcgaatggtcgtacgacctggcctggaagccgattctcggttttcccatccggttcggctggctggccgcgatccgccgtggccagcggcgcctgcaggccggtctcgacatcgacgtgccggtcctggtggcctgctcggaccgcacgtaccgcggccgcgagtggcacgacgacgtccacgtgaccgactccgttctggacgtcgaccacatcgtccgcttcgcgccgggcctcggcccgcgggtgacgatcgcccagttcaacggcggtaagcacgatttgaccctgtccggcaaggaggtccgcgccgaggtcttcaccgagctggcccgctggtccgaggcgttcctcgcggccccgggcaccgcggaggtcacgatcccgccggccccggaggatcagggcggccgggcgatcctgctggaggccgcggaggccgccgtcgaaaaggccgccgacgaggcggacgacaagtccggcacgaccgcctagtatgtgctggccagcgctcgtagctcagcggatagagcaccggacttctaatccgatggtcgcaggttcgaatcctgccgggcgcgcacagtaagccctatcagcaagaacgttcatgtaagcctcagccccacatccgggcgcgacccgatccagcactggattaggtgatgaggcgagacagtcaacggctatgggacagctacgcccgtaccctcagggcacgtaaccggccctctcggactgtggagagctacctcctggctgccacggagttggacgcgcgcctcggctgcaccgtggcggcagcgacccgtgacaagatctacagctgcctggggaagcggctcaccgacgtcagtgcaaccctgaggcccttccttcagaacatggtgcggacccacgcaactccagtggtcaaagcgacgaacactacgattgctcccatccgcagccagggaaccgactcgatcctgcgatcgatggcaatagacacgctgatccccacagtgattcccagcatcaggcacatgaacgccgtgagcgccctcctggccgggctgtcaacctcccagtacagccagaggccaccggctgtcgccacgaacagcaacagggtgaggacggtcagcgggaacgctaagcgccaacggagagatagcctcatgaccggttgatgcttccgcctcgggagtcgtcttcttcgatcttccggatccggattgcctcagactcgatcgaaagctcttcctgcgcaccacacataacgagcgctccgcaggcgccgccgtgctggccgcactgacgctcgtcgaagctgacgacctggacgctgccgaccggcacctcgatgccggacccggactgctgggtccgacgagccgacgcggtgccgatcgcgaccatcggggcccggctttcggtgtggaaatctgccgatgtgctgctcgtcgtggaggtctccgacgaaaccgtcctgcaggacctcaacgtcaagaccaggttgtacggtgcggccggctacccggtctactgggtggtgacccaggagcggatcttcgagcacaccggacccaccgcgtcgggttatcggacccggatcgagtatcggcccggggaccggattccggtcggctacgcgagcctcgaccttccggtcagctcgctgctcagcgacgactgaggcgagccggccgggaggccgccagccggccggctggcggcccgggtggtcagcggacctggatccggaccgtgtcgaaggcgggggtctggttggcccgctccatcatcgggatgcggtgcgagccgtcaccggcccacgaggcgcactgcgcggtgccggccgtcggcaggcccgggacctggatggtcaccgtgtccggggtgcggccgcccttgctgtcctcggtggcgacgaagaacgccggcaccgggtcgggggccggggcgacgttggtgccggcgagcatccggcaggcggtgtggaagtggccgcggacgatgccgttctgcagcacgctggactcgacgtagtaaccgccctggccggccgcgaggaagcggtcgcggatcaggttgcgggtgctgaccttgagggtgaaggcggtgttccggttgaccacgcggggcgcctgggtgatcagcagcgacgggttgttggccgccgagccgacctcaccgaactcggtggtgacgcagcggtcgcccttctggaaaccgtcgtgccgggccagcctgctcttgtcgcagttgttggcgaggatgcccaggttgctgccgggggcctggttggccgcggcggtggtggcggccggggccgcggcgccgttgagggtgcaggcggacaggccggccgcgttcaggttgggtttcggcgcgttgcggccgatggccgtctcgatccggctgatggtggcgaaacgcttgtccttcagcgggccgaggatggcgttctggatgaagttcgggccgccctggcccttggtgtcgacgatccgtttgttggcctcgtcgatctgtgtctgcagcagggccaggttgctcttcacctcgttctgggcttgcgccgggatggcgacgttgaccttgacctgggggcagttgacggtgggcgtggactccgcggcggacgcgaccccgaggccgatgccggcgaggaccaccgctactcccgtgaccgcgacgatctgccagcgccgcgacttgccgatttccgacgaccgatacattggcctgcgccttccccgagcaaagaggtacttcggccttcgatacgggatcgctcccacaacggatcaaaagttgggaagagaaatgctcgccgctctgctgttcgccgtcgccgcggtcgccttggcggccggtgtgctgctcggatatcgactcggacgggcccagtgccgggctgccggacaccggcattccggcaccggaactcagtagctgagcgtctcggtcaggggcggccgggccggcggggtcgccggcgacggcgccggccaccgcgacgcgctgtcgctctcctccggagagctgatgggggcgacgcccgaaccggtcaccgagaacgcgccgtagcgccgggcggtacgcccgggcggggccggaccgcccgggccggcgtctcagggaccctccggtggccgggcacgcgcccgggccagccggatcgcatgccgctcgacgagcccatgggcgcggcgctgcgcctagctagctagccatgggcgcggcgctgcgccgtcgcctgccggcgggcggcccgctcggccagctcggcccgccgtcgcgcggcgcgttccagcatctcgggcatccagtcgggcgccggggactcggtcgttgcgcggtgtgcggtggtcatggggggatcctcccggcggggtacgacagtttccggtgcggtggcccgggcgggccgagggtggcacaccaaccggcgaaagccccgccacccggcgggaaaatccgtttcggtgccggccgaagcgctgccaggatccgcatcgcgcgttgcacaagcacggggaccggcgagcgacgagtcagcgccggcccgggacgagggaggactgcgaggaccccggagcggcaccccgcaaacccctgaccacccgaccggctgttgggacctgacccacaccgccccggcgcaccccaccggggggactacgcttaacgccctgtgaactgggcttcggcgtggcggcccggacggtcggtgaaatgaccgaaacccaggccgacaaggccgaaacacggaacggaagatgatgatcgaccaggccaaggttcgagtcctgctgttggaaagcatccaccccgatgcggtgtcccggctcgaggcggacggcttcgccgtcgagtccgtgccgaacgcgctggacgaggccgagctggtcgagcgcatctccggggtgcacctgctgggcatccgttcgaagaccaaggtcaccgcgaaggtgctggaggccgccgacaagctggtcgcgatcggcgcgttctgcatcggtaccgaccagatcgacctgaccaccgcctcgtcgaccggtgtcgcggtgttcaacgccccgttctccaacacccgctcggtggtggagctggcgatcgccgagatcatctcgctgacccgccggctcaccgagaagaactcgctgatgcacgccggcatctgggacaagtcggcggacggcgcgcacgagatccgcggccgccggctcggcatcgtggggtacggcaacatcggcacccagctgtccgtgctcgcggagaacctgggcatgtcggtctcgttctacgacaccgccgacaagctggcgctgagcaacgcgcaccgctgcgccagtctggacgagctgctggagtccagcgacgtggtcaccctgcacgtcgacggccgcccgggcaacgccggtttcttcggcgccgagcagttcgccaagatgcgcccgggcagcctgttcctgaacctgtcccgcggcatcgtggtcgaccacctggccctgcgggacgcgctgcgcagcgggcacctgggcggcgccgcggtcgacgtcttcccgaaggagccgaagggccggggtgacgagttcctctccgagctgcgcggcctgccgaacgtgatcctcaccccgcacatcggcggttcgaccgaggaggcgcagtcggacatcggcggcttcgtggcgaacaagttggccaagttcctcagcgagggcaacaccacgctgagtgtgaacctgcccggcgtggtcctgcccgagcagcccggcctgcaccggatcgtgcacgtgcacgtcaacaccccgggcgtgctggcccaagtcaaccggatcctcgcggagcacaacgtgaacgtcgagggccagctgctgagcacccgcggggagtacggctacctgatcaccgacatcggcaagggctacagcgaagaggtgctggagcagctgcgcggcatggagcagacggtccgcctgcgcgtgctgtcctgataccgctccgaccgggccctgccgcgtgcggggcccggccggtcagcccgcctcgacgctgagcagcgtgaccggggcgaccgcgttcacgtcataccgtcccacggcgttccagtccttcggggtcagcgtggacccgggcgcgacgttgcgcagggtccgcgtgcccgcggtgacggtcgccgcgccgccgcccaccttgacccggatcggggtgccggccggggagcgcagggtgagttcctcgaccccgccggtgatcttcacgggtaccgtcccggagaccgcggacaggtcgagcacggctcgccgggtgccgccgaccacctcgatcccggtcacctgaccctgcccgaggtccacgtcgcgttcggcggcgtacccggagaagcgcagtgaccagcggacccgggcgctcagcacgacatccacttcgccgtccgcgccggcgccggagcgggtcacctgcaggcgtaccgcgtcgccgtcgacctgcgggctgggcagcaggggcgagtcgtccggggtgctgatccggaagaggtcgtcgccgatgtcggcgacgctgagccgggtccggtcgctggccgcgagcatctcgaaggacgccgtggaccgtccgccgagcggcgcggtcaccatccgggacccgccggggctggtggtggccgcgctcaggtgcaggatccgggtgatccgggaatccggaccggagtagaagaccaccccggtcagcgcgatgatcagcaccgcgacgataccgagcacggtcatcccggcggtcaccacgggggaacgccggcgcgggggccgcagcgcggcggccgccgccgcggagcgcgacggggtccgcggcacgcccggattgtccgaccggaccatgctctcccacgacccgaagttgctgtccggaatggagggacgcgtcgcggccgcctccggcgccgcccatcccgctgccgccggcgaggtcggatccgtctcggcggcattgcggcgtacgatcggcagcccgcccgggtccaccggaccccccgaccggccgccggcgtcgaccgccgcgggccaggagctctgctccgccgcgggccaggagctctgctccgccgcgggccaggagctctgctccgccgcgggccaggagctctgctccgccgcgggccaggagctctgctccgccgcgggccaggacgccgtcgaggaggaggacggggaggaggcccacgcgccctgaaccggcgcggccgtcgtcccgtccgagtcggccgtgtcaccggacccgcccagcggccggttcccactgatcggcccggcgctgaatccgaacgaggcccgccccggcccggccggcgaagccggcccgtattccggtgccgcgggcgtctcgcgcacccggttcgtcgccgccgacgaggacgaagccgccgccgacgaggaagaagccgccaccgaggacgaaggcgccaccgacgaggaagaagaagaagaagccgccaccgaggacgaaggcgccgccgacgaggacgacggcggaaccggggcagacgaagcggacgagtccgtggagaacggcgagccggacccggacgggtcggcgaaaccggacgaggacgacgggtcgacccacgccggcgacggccccaagtccaacgaggacccggttcccgccgatgaccggccggacgacggcgccgagctggagaaggagggcggcagcgacggctccgaaggcgacgccgcgtcgtcggccgccgaggtgccgggcgtggccgaggacgaggtcgcgaagcccgggaacgtctcgaacggggagggcgccgccccccgccgatagagccgatccgggtccttggaccgccgccgcggcaactcccctgctgacggcgacgactcgggtgttgacccgtcgctggcggtacggtccacggccgctgtcctttcccctgcggcgccgttaccgcgacgcccgtgggcgccgtcactcggcgcccgcaaaggaatacggaaagcaggcgtccgcggatgagcccgttcggttatttcaccgatggtccggacggacgagaccgcgccgggtggcgatcgccaccgcttccagctgggagtgcgcgccgagcttggccagcaccgacttctggtagccgcggcaggtgtgcacgctgatgccgagccgccgggccaccgcccgggcgtcgagcccggtggccatcagctgcagcacctcgtcctcacgcgcggtcagcccgccctcgcgggtcaccgacaccggcggggtgctgcgcagcagccgggccatgatgtcggtggagacggtcatcccgccgccgtgcgcggtccgcagcgcgttgagcacctcggcgagcgcgccgttcttggagatgtagccggccgcgccgaaggtggtggcccggctgatcagcccctggtcctcacgggccgtgaggatcaccacacgcacgtcgggttggcggacccggatcagctgcgcgatggcgatgccgtccgcatcggacagttccgggtcgagcaggatgacgtcgggtgacagctcggacgcgaggtgcaacgcctcctggccggtccgcgcgtgccccacccactgcaggtcgggctgcccggccagggcgtgtccgagcagctcggcaaaggtctggtgaccgtcgacgacgagcacccggatcgcctcgtcgttccccatgtgcaccatcctccgtcagcggtccggcccggcgggccccgcgcagtctaaggactacccgccatgtcgcccgccctaccaacagacggccgttgtgccacggcgacgtcaggttgccacccgagcggtcgggatgaccagtctttcggccgaggcgaccccccgcattggggcttgccgaccggcggcgggggtcgccacgattctgcatcatgtacgacatccagctcttcggccgcatcgaagttcgcacccggggcatccgcctggcgggcgacgacttcggcggtgaccgcccgcgccagttgctcgcgctgctggcgctgcacggcgagcagtcccttgtggagctgtccgacctgctcggcgcaccgcccgccacggtgaaggcggatctccgcgtgctgcgggaccggctggagccgggcgccagcggccgtgactcggtggtcgtcggccggcacgggagctaccacctggacaccgagcgcgtccgggtcgatgtcgccaccttcgagaagctgctggccgccgccgagggccgcaccccggagcgggccgcccgcccgctgaccgccgcgtcgtacgtggccgcccgcccgctgctggaggacgaggacgccgcctgggccgccgagctgcgggcgaagtacgacgccaagcggcgactcaccgccaccgccgcctgatcgggtaattcccgcgcaccgggcggcggacgggcgcacaatcgccgggtgctcgacgctccgaccgctctgctcccggtcccgctcgccccggagatctcgctccacctggtcgacgctccgctcggcctgttcgatctgaccggcggcgagttccacagcgacaccccgccgccgttctgggcgttcgtctgggccggcggccaggccctggcccgctacctgctggatcatcccgccgaggcggccggccgccgggtgctcgatctggccaccggctccggggtggcggcgatcgccgcggcccgctgcggcgccgccgaggtggccgcctccgacatcgatcccgccgcggtcgccgccgcacaccgcaacgccgcggccaacgcgctcaccctggcttccgcggtgtcctcgcccgatctggtgctggccggtgacgtctattacagcccgacggtcgccccgctgatcaccgcacagttgcgcgccttccgccgggaaggcgccacggtgctggttggggaccccgggcgtgggtatttcccggagagactcttcacgctcgtcaccgactatgtggtgccggtcccggagagcctggaggagaccggtgaactccgcaccggggtgtggcggatgcgctgaaccccgcacgaaacccggatgcctgatccacgcaacaacttgtacgctacacgtattgtccccggcgcccatgaggacggcaatcacgtgcaagaacagcagagcatctcgagcaccgcacgactgtccgacgaaatcatccggttcatccggatgggacagcgtttccgaggcatgctcaaaacggaggatctcggcgccgagttctccgcgttgatgctgctgctgcccttgcgggcgatgggcccgatgcgggtcaccgatctggccgagctcaaacaggccgacccgtcgacgatcagccgtcaggtcgcccagctggtcaaggccggcctggcccggcgggaggccgatccggcggacggccgggcctcccggctggcggtcaccgagaccggccaggacgcctgtgcgcgcctgggcgccgctcgcaccgccctgctcgaacgcgcgctgaacgactggccggccgaccgggtcgacactttcgtccagctcttcgaagaattcaacacgtccgtcgaggcgctgctgcgcaccgacctcggcgcaccaccacgggagaacgcgtgagccaccccaccccgacggccgcgagaccggccgcggaattcacccaccggcagatcctcacgatcctcgccggcctgatgatgggcatgttcctcgccgccctggatcagaccatcatggccacggcgacccggaccatcgccgacgacctcaacggcttcgacctgcaggcctgggccaccacggccttcctgatcacctcgacgatctccaccccgctgtacggcaagttgtccgacatctacggccgtcggccgttcttcctgttcgccatcggcatcttcatcgtcggctcgatgctctgcggcctctcccagaacatgtacgagctggccgccttccgggcgatccagggcatcggcgccggcggcctgatgtcgctggccctggccatcatcggtgacatcgtgccgccccgtgagcgcgccaaataccagggcttcttcctggccgtcttcggcaccgcgagcgtcctcggcccgatcctcggcgggttcttcgccggcgccgaccagctgctctgggtggacggctggcgctgggtgttctacctgaacgtgccgatcggcatcgccgcgatggcggtggtcgccaaggtgctgcacctgccgcacacccgggtcaaccaccggatcgactggccgggcgcggtcgcgctgatcgtcggtctggtgccgctgctgaccgtggccgagcaggggcgcacctggggctgggactccggccgctcgatcctctgctacgtgatcggcgtggtcggcctgatctccttcgtgatcgccgagcgggcctacaaggacgaggcgctgctgccgttgcgactgttcggcaaccgcacgatcgcggtcggcaccggggccagtacgatcctgggcatcgcgatgttcggcggtctgatgaccgtcccgctgtacctgcagatcgtcaaggggtcctcggccaccatggccggcctgcagatgatcccgttcgtgttcggcatcatgtccggctcgatcatcgccggtcagctgatcgcccggaccggccgctaccggatcttcccgatcctcggcagcaccttcatggtcatcgcgctgttcctgttctccctggtcggcgcggacacgccgctgtggcgcaccatgctgatcatggtgctgatgggcctcggcctgggcggcaacatgcagccgatgatcaccgcggtgcagaacgcggtctccccgcgggagatcggcgtcgccaccggcgcggtcaccttcttccgctcgatgggcggcacgatgggcaccgcggtgttcctgtcggtgctgttcaacgtgctcccgggcaacatcagggacgcgtacgcggacgccgcgaagaatccggagttcctcaaggccgcggccgacccgacccagcagcagctgctcaagcaggcgcagggcggtggcgggctgagcgacacgtcgttcatcaacaagctgaccgacgtggtcgcgcacccgttcaaggtgggcttctcggacagcgtccacgtggtctatctgctcgccttcgcaatcatgctggtcggcctggtgatcgtcttcttcctgccggagattccgctcgccatgcgctccgcccagcagcagcgggccgatgacgcggcggcccagggcgacgcctccggcgccgatcagggcaccgcgggggtcaaggccggcaccgaaggtttcgctcactgacccgacaggtcaccgattcgggggtacgcacggcgcgcgccgttcgtacccccaatcggttttgccgtggggacgcttaggaaccaccggtagcgtgaccgcatggctgttgtgaagatcaacgcgattgaggtccccgagggcgccggccccgagctggagaagcggttcgccgcccggcacggggcggtcgagaacgagcccggcttcctcgccttcgaactgctgcgcccggtcgccggcgacaaccggtacttcgtctacacgaagtgggagtccgaggaggccttccagaactggtcgcagggcagcgccaaggctgcccacgccggcgagcgcgccaagccggtggcctccggcgcctccctcctcgaattcgaggtcatccagcacgtcaccaagcaggactgaggcgagaagtcaggagcggtcgcgggcagcggcagcgggcggctgacaggtcagcgccggtcgcgggcaacagcggcgggcggatgacgggtcaggactggtagcggtcgcggtcgcggcagcggacgggtgacgggtgacgggtcaggactggtcgcggtcgcgggcagcggcggcgaccagccgctcggcgaccgtgacccggtccaggccgagccgctgcgcgctgtcgtgcaggatccggtacgcctcctgcacgccgcagccgcgctgggcaatgatcacgccgaccgcccggtcgaccgcggcgccctcggtcagtgcctcccgccggtgcagctcgccgatcagcacctcggcctggccggccaccgccatcacggtgagcagcacctccggcgcgaccggaccgggcgcgccgagcccgacggtgagcgcgccgaccgcgtgccggcggacgtcgaggggaaccgacgcgaccgccacgatgccgtccgcgcgggccgggccggacagctccggccaacggtcgtcggcccccagatcctcgctggtgaccagggtccgggtgcgggccgcctccagcccgggaccgctgccgtcggcgtactgccgcgcgtcggacgtctcgccggcggacccggcggcggcgacggtgatcggtccgccctcgctgatcagcgcgaccgagcagcggaccgcaccgggcagtgcggcgacggtgagcccggccagccggtcgagtgcggagcggaccgtgtcggcggtcagcagccggacgctgacctcgtgtagcagcccggccagctcctagctagctaggccggccggcgacgagcctgcgggcctggccgggcggggtgccgccacccagggtggcgcgccggcggttccggatgccgcgctgggcggccggtacgcgacgttgcggtactgacactcgacggatactgccatgtcgatccgcgttcggctcgttacggtgccccgatcggggggtcttgcccgtttaaacccactcggccccgaacgtggaaaaagacgcgtccccggggggctccccggggacgcgcgagacgttagatgccggtgtgcaggtcgcctcgcggcgagtggctcagcacggctccagccgaacggtattccgtgcaggcgatgggtgaggcccggggacactgggcacaccggcatccgttcacaaccttcggcacccgcccatgattccgggagcccttgtgacctgaataacaccgcggacgtttgtccggcccggcgccgggtaccgatccgccgtgaccgaatccgaggaaaacctacgcctggccgcgttcctggacggcgcgtaccgcgccgaggaacggatgagcagcggcgatctgcagcggcgggcgatcgccgaggacctgccggcgagcctgctcacccgggtggacgcgctgcccgagggcgaatacctgcaggacgaggccgccgaggcactcagcgccccggcgatctgatcactcggcccgctccttggcgatgctgtaggccatctgcaggaagtccgagacagcggtcgcggtgaacgcggtggccaccagccgggtcagccggggcgccaggaccagcccgccggtcaggccggtggcgatccaggcggccaggcagaacgggcaggtgatcagctcaccgatgccgtgccgcaccgggctgccctcgtcgcgcacctcctcgttgagctcggccgccccggcgggctcggtgtaccgggtgaacggcgcccgcagcgggctggtcaccgagtccttggcgatcagccggctgatcttgtgggtggcaatcgagagcagcaccacgtcggtcatggccgggcgttccggcaccggcttaccggtcagcttggcggccgccgcgaggctggccgcgagcgtgccgaaggcgcccatcgccaccaggtagccgcccagcggccggtggtcgtgcggggcgtaagcgcgggccacctcggcgacccgggcctgcaggctggacatcgtggggggtcctttcaagctggtcagaagccgggcgggtccagaaccggggtgggggagacacgagcgggtcagaaggcctgggtcagccgctccgggtcgacctcacgaccggggaagcgcgccatgtactcggtctccagctccgcggtgcgccggaaatggttgtccagcgccgcgtccggcccgtgccgcagggtctgcagccgggtccggtagaggctggtcaactcccggaagaggtcgtcgtcggcgagtccggccgggtcgatcccggtgtcggtgccggtctcgggtcgcgctgtcgtcatggtgcacctccagcgatgcgggcgaacggggacaaccggtggcttgcccgcgcgggtccgcgccaaacccgccggtaggctcgggggcatgaaagggctgtggtctccggcgtggatcgcccgccacctgctggcgctgatcctcaccgcgggctgcctcggcctgggctggtggcagtacagccgggccaccggcggcaactcgctcagctggggctacatgttcgagtggccggtcttcgcgggtttcgtggtgttcatctgggtccgcgagatccagttgttccgcaagccgcgggacaccggggcggaggccgagccggccgagccggagcgggttccgggcgccccggtcgccgtgggccggccggtgcgggtcgcggtccggcccgccgaggcggtggcggccgacccggagctggacgcctacaacgactatctgacctggctcgccgagcaccccggcgcccgcccggccgactaccccggccgcatcatcaagtagtagaagctcgaaggagacccccgtgcgcggcgcgctcacccgttaccggatcattgcctggatcgtcggcgtgttcctggtcgttctcgtactggtcggcatgccgctgaagtacttcggcgacaacgacacggtggtcgcggtgatcggcccgctgcacggtttcctctacatgatctatctgctgttcagtttcgacctgtcccgccgggcccggtggcccttcggccggatgatcctggtgatgctggccggcaccatcccgttcttctcgttctgggcggagcgtcaggtgacccggcactggatgactgaagtagcgtgggaaccggccgtcaaataacgcagcgcgcgggtcgaataacagcccgttatcgggattaagttcgcaagaccggctattcgcagatttcacgcgcggaggacttgattttgttttctgcgccgataagttgatgcggttggttcggtccgcagccacaaaccctccgggtggcgccggccaacgccgctgaatctcacgagccggggacccatctttccggggtgaatccgccacgcgcggtaggacgcctcttccgagtccgaacccgtcagctaacccggtaagcggccatgagcggaagaaaggccccctgaccagtgccactcccccgtaccaggctccgggcgctggtggtcgcgctgaccgcgctggcgatcaccacgtcgggcgctaccgccgcgcacgcggccccgtccaaggacgagctgaagaagcagatcgaggcggcttccaacaagctggacgacgtcaccgaggcgtacaacaagacccgcatcgacctgaaggcgacgcagaccgacgcggccaagctcaccgcgtccctcaagccggccgaggcggcgaagaaccaggccgtcacgaaggtgaacgcgatcgccgcgtcgtcgtacatgaccggccgggtcggcccgatgaccctgatcctcggcggcaaccagcatgacctgctggagcggctgagctacctggaccagctcagcaagtccaaccaggcgcagatcgacaactacaccgaggtcagccggacctacacgtctcggcaggccgagctcaaggccaccgagcagaagcaggcgctgcagctcaaggagctggacgcgcagaaggccaagtacaccaaggatctgcagaagctgaccgcgacgcagaaggaactgtacggcaagccgacgcagagctccggctcgtggaccggcccgatcccgaagggctccggtgacgccggggtggcggtcgccttcgcgtacaagcagatcggcaagccgtacggtttcggggacgagggtcccaactcgtacgactgctcgggtctgaccaaggccgcctgggccgcggccgggcactcgctgccacacagcgcgtccgagcagcgatacgccagtggtgtcacctacatcaaggcgggcaccgcggggttcgtccccaagcagggtgacctggtgttctatcgcgacggtggccacgtcgcgctgtacgtcggcagcggcatggtcatcgacgcaccgcacggtggcgccgacgtgacccgccgcacgatcaacatcatgcccgtacagggatacggccggatctcgtaacaccgcgcacagcgagaaggccggcacccgctctcggggtgccggccttctctcgtcgtatcagggtcaggcggcctgcaggccctcggcccgggccagctcacgcagccggccgagcgcctggatctccagctgccggatccgctcccggctgagcgagaagcgcgacgccacctcggtcagcgagtgctcccgaccgtcctccagtccgtaccgcgcccgcatgatgcctgccgaccggtcgtccaggtggttgagcagcccctcgatccgctgccgctccagggcgctaagcacgatctcctcgggcgacggcgcgtcgctgtcggcgaccaggtcgcccaggttggtgtcgccgtcgtcgccgaccggagtgtccagggacacggtgtcctgggcccagcgggtgagctcgttgacccgctcgacggtgacgccgagagccgccgcgatctgctccggctccgggtcgccgccgagctcacggaccagctggcgggtcacgttgcgcatccggttgacgtcctcgaccaggtgcaccggcaggcggacggtccgctcctgctgggcgatggcccggctgatcgcctgacgcacccaccacgtcgcgtacgtggagaacttgtagccgcgctcgtagtcgaacttctcgaccgcgcggaccagaccggtgttgccctcctggatcaggtcgagcatcggcatgcccgagcgcacgtagcggcgggcgatcgagacgaccagtcgcaggttggcgcgaatgaacaggtccttcgcccggctgccctcggtgacgaggcgctcgagctcctcccggctgatgccgcggcgctcctcgccctgctcgagcaggtgctcggcgtagaggcccgcctcgatcgccttggagagctcgacctcccgcgcggcgtccaacagcggcgtccgggagatctcgtgcaggtagactccgacgaggtcgcgctcctcggcaacctggtcggtacgcatcacggtgttcttctccacgttgcccacggtcccctcattgccgtcactaaccctgttacgggcattacctgcgtccatcagccctctcccgtaacgtccgcagctcgtgcattgcggttgctgacatctacacaacaaatggctgcctgcgctgattccgcctggccgatcgaaagtgtcacgaatgcctgggtcttacctgagagcccagtgcgcggtagctgagcgcggcccgtaccggaccgccttgcggatagacggttacccgtcgcgcgcctcataacaccatcggcctctcatcgtccacagcgacgggcatcaccttgagtgccgcgacgctcgtcaccctggcgctcgataccctgatatacgggtgcgccgcccctggggttcacgtgcagcatcgaccggctgccgacgggcctgaatcaaacgcgaccgtcaattgagatcgcaccccgccggccgcacccgccgaacgggaccatcggtcacgatgcggcacggcgcgtcgcagatcactcgcccatccgggtgacgctccccggaccggtgacattcgtagccgcggcctcgacgggtgggtgaagtgagcaacaccacacccgggaagatcttccccatgaccaatactgctctggtgaccggcggcaccggcgggctcggcgccgccaccgtcgcagcgttcctggcggccgggtggcgcctagctagctagccgtggcggcggccaccgccgagccgggcgccccgctgaccgcggtggtcaatctggtcggtgggtatgcgggcagcggcctgatcgccgacaccccggtcgacgagttcgaggcgatgttcaccgccaacctgcgtcccacctatctggtcaccgcggccgccctgccgcacctggtggcggccggcggtggcgcggtggtcagcgtctcgtcgcgggccgcggtggcgccgttcgcgggcgcggccgggtatgtcgtgtccaaggccgcggtgctggccttcgccgagaccgtcgccgtcgagtaccgccggcagaacgtgcgcagcaacacggtgctgcccagcgtgatcgacacgccggcgaatcgggccgcgatgccggacgccgaccacagccgctgggtcgacccggagtcgattgccgcgaccatcctgttcctcgcctcggatgcctccgcaccgaccagcggcgcgcgcatcccggtctacggccaggcctgacgagccggatcaggccgggaaagactcagcaagctgccaggccgacacggcggcgccggtcacggcggaggcgccggccagcaccaggctccgtacccggagcgggcgctgaaccggcgccgccggccggcccagcgcccgctgaacggcgtcgaagacctggtcgggcgaaccattggcatcaatcacggtaaattcggcaaattccggcaattggcggtacgccatatccgcggccgtcagatattccagtgactcgctgtcccggccgcgcagctcgatccgcgctctggccacgcccggatccacggccaggaacagcgtcacgtccggccgcgggaacacccggtaagccagccgcgcccggcgctcggcggccgccgtcccccggtgcgcccgcacgctggcgtactggcagaccgcgtaccggtccatcacggtgacctcccgacggaccgctcgccgcagcagcgtccgggcgatcgcgagccaccgcaacaccgactccatcagcagcaggccgcggcgcccgagcagcccgaccgcgtcctcccggccgaggcgtacggccagccgcccgagccgggcccggccgccggcgttctgccggtagcgggccggcgtcccggcccgggtcatcgcggcggcgagcatccgggcctgggtggtcttgccggagccgtcgatgccgaccagggcgatcgtgcgcgggcgagctgtcatgcccaccgacggtagccggggcgcgcactgcgcgttccccctcggcggtgggcggaacggaccacaatgatcgtcgagggttcaaggtgcggccaccgtgggtaatggtcacgaattggacacggacaggaggtcaccatgccgcaccgggtcgacgaggggctggccggcacgatgaaacgtgtcgccgcgaccctgaagaccgcggagatccccttcgcgctggggggcagtttcgccgtctatgcccacggcggacattccagcgatcacgacgtggactttctgatccgcgagcaggacaaggaacgggccctgcaggagctgtccgaggtcggcttcgagacgctggagccgccggaggactggctggtcaaggtcttcgaggacggccggatggtggatctgatcttccgcccggtggagactccggtcaccgacgagacgctcgccgacaccgagcggatctcggtcgaggcgatctacatgccggtgctctcggccacccagctgatgattcacaagctgctcagttacagccagcaccactgcgatttcgcccaggggctgccgctggcccggtcgctgcgcgagcagatcgactgggcccgggtccgccgggagaccgcgaagtcgccgtacgccgaggcgttcctcgtcctgctggaccggctcgacgtcgtgccgaacaagtccgacgagggtgaggactgacgatgaccaaacagatcgacctggaggccgagatccagcggctgctggccgagcacgaccggatcgccgagcagggcgtgaccgtgcaccgccgggagaacctgctgatgctgggcggcgaggtggagagcgcgcagcgtcgggacgagatctgccggcagatcagcgcgcgctaccccgacctggagatcgcctgcgacatcggcatcacccggacccaggcgcccgccgaggtggaggagatttcatgatccggatcgccgccgtgggcgacgtccacgtggacaaggacgtggtgggccggtaccggccggctctggaggagctgcccggccgggccgacgtgctgctggtcgccggggacctgacccggcacggaaccccggaggaggcacggtgcttcgccgccgagttcggtgacctggccgtgccggtcgtggtggtgctcggcaaccacgaccatcagagcgaccagcaggacgaggtgacccgggtgctgaccggcagcgggatcaccgtgctggagggggccgccaccgtactggagatccgtgggcatcgactcgggatcgccgggaccaaggggttcggcggcggcttcgccggcgcctgcgcgagcaacttcggcgagcgcgagatgaaggacttcgtcgggaccaccgagcggtacgccgcggctctgcgcgacgcgctgctctcggtggagtgtgacgcgctggtggcgatgacccactacgcgccggtcccggagacgctgaccggcgagccgctggagatctacgcgttcctcggctgttaccagctgggtcaggcgatcgacgacgcgccgaccgcgctggccctgcacgggcacgcgcaccacggctcggaacgcggccggaccccgggcggagtaccggtccgcaacgtcgcgcacccggtgatcaagcaggcctacaacgtgtatcagctgctcacggacaccgtggacacccggaacgaggaactcgtcaacgtctgatcgagaaccaggtttctgattttcggacatcgggtaccagcagcgacatggacctactgctctggattctcgccgtaatcctcgtggtcgccggcatcctcgcgctgttccggcggcagatcctctggggcgttgtgctgatcatcgtgggcctgctggtcggccccggcggcgtcagcatcttcacctgatcggcactcccgcaccccgacccccggtaaccgtttcggcaccgtctcacgttcctgaacgtgagacggtgccggttctctttggtgcgtcgacgcactgcgggtgcgatgcgcgactgctgattcctgactcactaccccgcggaccatcgcccatgtttcgcgaggtagacccgtggccgcacatattcaccacttcacctatggagccttcaacccgatcgccgcggcgctgctggcgtacctcggctcgttcctcggactgctctgcaccgagcgggcccggggcgcgcacagccggggccggcgcaaccgctggctggcgatcgcggcgttcgccatcggcggcggcgccatctggctgatgcacttctccgccatgctcggcttcgacgtgccggacagcccggtccgctacgacctgccgaccaccctgctcagcatggtcttcgcggtggtcaccgtcgggatcgggctgatggtggtggggcacggcgcgcccagcccggccaagaccgtcgcggccgggttcctcaccggtggtggtgtgctggccatgcactacaccggcatggagggcatgcggatgtccgcggtggtgcactacgacccggtgctggtcgccgcgtccgcgctgatcgcgctggccgcctgcaccaccgcgctgtggttcgcggtgtcggtgcgcgggctgacccggatagccggcgcggccgcggtgatggcggtcgcggtctgcggcatgcattacaccgggatggccgcgatgtcggtccggctggacccgtccatcgtcccggcggccggcggcatccggccgctcaccatgatcgtgccgatcactttgatcaccgcggcgaccatcgtcggggtggcgctgagcgcgctgcaggcgatgaccgaggaggagttcaccgacggggccggcaccccgaagcgcggtatgcacgccgaaccgcaccagccgtggacgctgcggcaggcctcgcagttcggcaccggggtgcggctgagtccggcggcgagggcggtggccgccggccctagctagctagtgcgcccggcgccacggccgccgaccttcgacccgtcggtggccggtgccccgccgatcgtcccggtcgcgaccgaaccgaccgtcccggtggcgccaccacccgcgccggtcccgccggtgccgatcccggaccaggcgagcggcccggtggcgggtccggccacatccggcacgtgaggttttccccgtcgcggccgatgatccggtatacctgatccgcatggcgccacggatgctgctctcgatgccgctgcacgcgatcaccgaggtgtacggcgaggaggggctgcggcaacgcttcggcctggagctggagtcgtttccggccgccgaccgggagcggctgaccgaggccctcgacctggccgccaccctgcacgccgacgatcggcgggtccgtgagccgtacctcaaccacctgctccgggtcgccatccggatcatccgctactaccaggtgcgtgacgtcgacgtgctggtggccgccctgctgcacgacgcggtcgaggaccatccggcagagctggccggcctgccggcggacaccgcgtaccccaaggccaccgaggcggccctggccgtgctcgcccaccggttcggcgcgcgggtctccgagctggtccggtcggtcaccaacccggcctacgacccggggcgggaccggcacgagcagtaccgggagcacgtcacggcgagcctggaccgggacccgtgggcgcggatcatcaagatctccgacttcaccgacaacggggtcggcgtgatccacaccacgctggacaaggcgtaccgctcggccaccaagtaccgcccgctggtgccgaagctgcgtgagctgatcgggcggccggacaccccgctctccacccaggccaaggagcacatcctggaccagctggacctggccgaggagcgtttcgcggccatcctcgacgactgaccgcacggcgctgcctatgttggtggcatgccctcccacgattcctggtggcgcgacgccgtcatctaccagatctacccccgctcgttcgccgacgggaacggcgacggcatgggcgacctgcccggcatcacggcgcgcctgccccggctgcgcgagctgggggtggacgccgtctggctgtccccgttctacgtcagcccgcagcacgacgccgggtacgacgtggccgactaccgcgatgtcgacccccgtttcggcaccctcggcgacgccgacaagctgatcgccgccgcccacgacctgggcctcaaggtcatcgtcgacctggtgccgaaccacacgtccagcgagcacccgtggttccgggccgctctggccgcgccgcccggcagcccggagcgggaccgctacatcttccgggacactccgccgaacaactggcagagcgtcttcggcggcccggcctggcggcaggtcgccgacgggcagtggtatctgcacctgttcgacgtctcgcagcccgacctgaactgggaccacccggaggtccgcgccgagttcgtggcgatcctgcggttctggctggaccgcggggtcgacggcttccgggtggacgtggcccacggcctgatcaaggacgccgagctcaccgactggacggcgccggccacggtgctcggcggcctggagccggccggtcccccgccgccgatgtgggaccaggagggggtgcacgagatctaccgggagtggcgcgccgtgctggacgggtacgacggcggccggatcctggtcgccgaggcctgggtgcagcccgaggagcggctggcccgctacgtccggccggacgagatgcaccaggccttcaacttcccgtatctggaggcaccgtggcagccggccgagctgcgcgcggtgatcgactcctcgctggccgccaccggtgcggtcggcgcgacgaccacctgggtactgtccaatcacgacgtggtgcggcacgcgtcccggctcggtttcccgcccggcggaaagcgcaagccggggatcgggatcggcgacccgcagccggacaccgggctgggcctgcgccgggcccgggcggccaccctgctgatgctcgggctgcccggctcggcctacctctaccagggtgaggagctcgggctgccggagcacaccacgctggccgacgagttccggcaggacccggcgtgggagcggtccgggcacgccgagcgcggccgggacggctgccgggtgccgatcccgtgggaggccgacgccccgtcgtacggtttcggcccgggtgacgacagctggctgccgcagcccgcgctctgggcggagtacgccctggaccggcaggtggacgtgccgggctccacctacgagttgtaccgctcagcgctggccgcccgtcgtgcgcaccggctgggcggcggcacgctggcctggtcggcgaccgagggtgccgtgctggcgttccgcaacggcccggtactggtgctgaccaacttcggggcggagccggtcaccctaccgcccggcgcccgggtcctgctgagcagcgagcccctcgacgccgacgggcggatccccagcgatgtcacggtctgggcgctggcctgatcgcttggccagcagggcggcgtgggtggccgccatgtccaccgcgaccgtcctgctggccagccagtacatgatcccggtcgggatgaagaagaactggaacgaggcgagcccgaccgcgtagttcagcggcggcgggaacgccccggccagccgctggaaggccaccccgaccagcgcgttcccgccggcccgaccggccccgttgaccaggttgcccaggctgtagacggtgccccggtgctcgggcgggttcacgtccgagatcatcgcgaaccagttcggcgagttcgccgaggtcagcatcagtgcgaagaccgcggtggccaggcaggcggcgaccgtcggctcggtgaccacattggtcagcacgccgcggatcaccgcgccggtgctcgcccggtccggcacccgaatcgtcatcgggacgaggaacagcaccacatagaacggcacggcggccaggatgccgaccgcggcgaccagggcccggccgcgcggtgtccgccgttgcagccggtcgccggcgagcccgccgaggatcgacagcgcggcgccgagctggaagaccgtcgcgaagacactgcccaccaggaccgcggtcggtgtggagtagccctggtcctcggcccgggcgcggaacagcaccggcagccagaccagcgagccgaaggcgatctgcgcggtgccaccctgcaggatcagccagatgttggtgcgtcggcccaggatgatcggcaggtggtcgtggtggatccgctcgtcgtagtcgatcccggccaactccggctggctgtcgccgcgcggcacgttgtaggtgaacaggtacagcgccgtggcgatgcccccggcgaccgcggtgaccaggaacggcctgcgccagtcggcgtgcccgagaatgccgccggccagcgtgccggccagcgtgccgacgccctgcgacagtccccagaaactcatcaccaggccccggcgccgcggtgagatcaggtcgctgaccaccgagaaactgaccgaggcgaccgcgcccaggccgaccgcggcgagcacctgggcgctcaggaacgcgccgtacccgccggccagcccggaccacgcggtgccgccgatccagatcagcgtgccggcgatgagcaccggtttgcggtcggtgcggtcgcccgcgtaagcccagccgatcgcggcgaccgcgctgatcccgaacatgaccgtggtggccagcgcgatccggccctcgccgaccccgaacgcggcgccgatgctgccgtacagcggcggcacgatgccgatcgccacattgtccagcgaggcgaggatcacgaacaccaccacgctgtacgcgcggtgcgcggcacctcccctggccttcacaccggtagaggttagcgactgttcggcccgcggtcagggccgcgttgccgggacgaccacggttttcgatgatcgggtcgcatgctgatcgtgcggatcgccgatttcgtccatcccacctcggcggcctccgcacggcgcggacggctgtcggcggagcaggacccgcggctgagtctcgcggcgccggccgcggtgcgcgcggccgggtggacgcccggccggtggaggccggcgacgagccgaggcggccggcgctggtgccgacgccgacgatggtctcgttcgactgcacctgtccacttcggtgaacgcccactgcgacgaaacttcccgagaagatgatcgcgggggtacgacgtgcccggcgtacccccgcgacccgcagagactctcaacggctccggtccaccaccctgtcctgggcggccgcgtactgctcccggatcaacggcaccgcgtcgtcctggaagacctccgggggctcggcggaccaggccggcggggtgtccccaccggcgaccacccaggccgcctgccgggccgcgccgtccgccacgtactccccgggcggcgggaccagcaccggtttgccgaacagcgcgggcgcgatccgacgcaccgcttcgctgcgtgccccgccgccgaccagcacgatccggttcgccgcggcgccctggccgaccagcgcgtccaggccgtcggccagcgcgcacagcatgccctcgacggcggcccgggccagatgcgccggatcggacgtcttcagggtcaggccgtggatcgcgccggtggcgtccggccggttcggggtccgctccccctccaggtacggcaccaggaccaggccgtccgcgccggccggggcggacagcgccagccgggacagctcgtcgtgcgagacgccgagcagtttcgccgcggcgtccagcacccgggccgcgttgagcgtgaccacgatcggcaggaaccggccggtggtgtcggcgaacccggccaccgtgccgctcgggtcggccggcgccgcgtccgacgagacgaacaccgtgccggacgtgccgatcgagacgatcacgtcaccgggcagcgcgccggtgcccagggccgccgccgcgttgtcgccggcgcccgggccgagcggtgcgccgttcggcaggtgcccggcgatcccggtggggccgagcacctcgggcacccgcaggtcccggccgaagcccagctccagcaggtcgtgccggtaccggtcggtgctggccgaccagtagagggtgccgctggcgtcgctgcggtcggtgcgcaggtcggccaggtcggtggagccggacagcttccaggtcagccagtcgtgcggcaggcagaccgccgccacccggtcggccagggccggctcgtgccgggccagccagcgcagcttggtcagggtgaagctggccaccggcacgatgccgaccgcctcggcccaggccgcgccgccgccgagctcggcgatcaggtcggcggccgcgccggcgctgcgggtgtcgttccacagcagcgccgggcggaccacgtcaccgttctcgtcgagcacgaccatgccgtgctgctggccggcgaccgaggcggcggccacgtcgtccaggccacccgcctcgtcgatcgcctgccgcagcgcggcccaccaggcgtccggatgcacctcggtgccgtccgggtgcgccgcccggccctgccggaccagcttcccggtctcggcgtcccggacgacgaccttgcacgactgcgtcgagctgtcgatcccggccaccagcgccatggtcagcgcgctccgagcaggtgctcgatggcgagctggttgaggcgcacgaagccgtagccccgggcgccggccgcgtcggcgtcgaagtcctcgaacgcgctgtggtcggcgagcaggtcggcgtacgtctcgccggggttcagcgtcggcgcggccagctcggcgaccttggacgcggccagcgcctcctgcacctcggggtcggcgcggaacgccttggcccgctccttgagcagcaggtacatccggatgttggccttcgccgactcccagacgccggtgacgtcctcggtgcgcgacggcttgtagtcgaagtgccgcgggccgtcgtaggcctggctgccgtcggcgccgttctccagcaggtcgaccagggagaacgcgctgagcaggtcaccgtggccgaagaccaggtcctggtcgaacttcgggccgtgctggccgttcaggtcgatgtggaagagcttgccgtgccacagcgcctgggcgatgccctgggtgaagttgagacccgccatctgctcgtggccgacctcgggattgatgccgaacagctcgggccgctccagctcctgggtgaacgcgatggcgtgcccggcggtgggcagcaggatgtcgccgcggggctcgttcggcttcggctcgatggcgaagcggaggccccagccgcggtcctcggaatactgcgcgagcaggttgagtgcctcacggtaccggtcgagggcggccttgacgtccttggccgagtcgtactcggcgccctcgcggccgccccacagcaccagggtcttggcgccgagctcggcgccgagctccatctggcgcatcaccttgcgcagcgcgtaacgccggaccgagcggtcgttgctggtgaagccaccgtccttgaacaccgggtggaagaacaggtcggtagtgatcatcgggacggtcaggccggtctcgtccagcgccttcttgaacccggccacgatgccgtcgcgggtctgcgcgtccgatccgaacggcaccaggtcgtcgtcgtggaacgtgactccgtacgccccgatctcggcgagcttgtacagggcctcgaccgggtcgagcgcgggacgggtcgcctcgccgaacgggtcacgtgcccgccagccgacggtccagagtccgaacgagaacttgtcctcacgagtgggctgaagcgacatcgtaacctccgcgatttgtttattggttgaattatttggcgggggtgtggcattgtcaagggcgtgacggcccggctcaccagcagatccagcacgcccgtccggcagtcaagcgtccgcgcccataatctcgcgctggtgctggacaccgtggcgaacagcgcggatccaccgtcccgggcgtccgtcgcggccctcaccgggctcacccgtgccaccgtctccgcgctcaccgacgacctgatcgccggcggcctgctggtcgagcgggacccgccgccgcgcaccggggcggggcgcccggccgccgggctcgcgctcaccgcggctagctagctagtcgccgccgaggcggacggcctggtgatcgccggcgccgcgctcgccgtgcccggcctggtctccaccggcctgatcccggccggcccgggcgcggccggacccagcggccccggtgcggccgggctggtccgggtcgcgccgaacctcggctggcaggacgtggacgcgccggcgctgctgcgcggcgtcccggaactggccgacctgagcatcgccgtcgacaacgaggccaacctcgccgccctcggcgaactgcgggtcaccggcggaaaccccgacttcctgtacgtttcgggcgaggtcgggatcggtgccggcctggtcatcgacggcgagctgtaccgcggcgcccgcggctggagcggcgagatcggacacgtcaccgtctatccggacggccggccctgccgttgcggcgcgaacgggtgcctggagcagtacgccgggcaggaggcgctggccgcggacgagccgctggccgccgccgcactggggatcgcgctggccgccgtggtcaacctgctcgacgtgccggtgatcgtgctcggcggggcctacgcgccactgttcgaccggctgcgcgacgggatcgaggcggagctgcgccgacgggtgctgacctcggggctggcgccggtcacgctgcgcgcggcgcgactcggggccgaggcggcggtgcgcggggcggcggacgcggtgatccgggaggtccgggacgatccggcgcgctggctacggcgtaccgcgtaatcgtgttgcgcaccgggacgggaaacggccgccacccctcgcgggatggcggccgtgggacgaccgggggacggcgggttactcgacgccggtgcgcgagccgatcgcctgcaggaagatgccggtgatctgggtcgggtccttggcgaggaacacgccgctgcccttgaccacgttgctgatcttctccagctcggtgcggtcgacgccgtcaccgatgccgatcagcacgagccggaccggcttcgtcgggtcctgcgccttcttcagataggccagcagggtgtcctggtcgatgccgtcgtcgttctcgttgacgccgtcggtgaacaggatgaccgagttcgccttgccggccttccagttcttcttcgacgtgtcgtaggcgtcccggatcgtgtcgtacagaccggtgttgccgcccttcttcgggttcagcagcgggatcgtggcctgcacgtcctgccgtccggtgctcagcggcgtgatcgggatcagctgcttccacggcctggtgccgtccatgtcggtggagaactcccacacgccgaccgcccagtcgtcgctgaacagctgcagaccggtccgcgcggcggcctgggtgaccaccgctttcgaccggttgccggcctgcggcaccgggtcgttcatcgacccggagacgtcgaagacggccagcacccgaccggcctgggtggtcgcgttccaggtgccgaccaccttgctgaccgacgcggcgtcgacacccgacgctgcggtgccgccggtgtcaccgccgcccgccgtgttgatcgccggcgacgccttcggcgcgccgaccggggcgacgaagccggcgccgtacgtgccgtccggcgcgcgcagcccctgccccgcgagccggctcttgaacgagcccgaggtgagctgggtgagcaggccctgcgcggcgctgatcttctgcccgtcgacgacctgcggcagcaccgagtacgggtagtcgagcggcaccgagggaccgtccagatagacggcggtcagctcgaccggcggacgcttcgcgttgtacgagatcacgtcctcctcggagagcggggcggcgcccagactctcctcgagggtgtcctgatcggtcgccttggggaactgctccagcagttcgtcccgcagctcggaccggttcttggcgagcagcgtgagcgcctggacctgcgccttgaccgccgcgtcgccggtgccgacgttctgcgtgaccgccatcagcgcggtcaggccggaggcgtcccgggccgggttgacgatgccgaacttcggcccgtccgccgacttgagaccggcggacagcagcgcggtcagcgggaccttctggccctccagtttcctggccaccgcgatcggctgcggcatggcgacgaccagcgggctctgcgccaccgaggtgaccttggtgggctggaagccggaggcctcgttgcgcaggcggagctgccaggtggacgagtcggggatccacacgtccggcacctgggtggcgcccgacgcctgcccgaggccggccagcacgacaccgtgctgcgcggcgatcgcgctggcgacgtcggccgggttgacggaggtgaccgcgaccgcgacgcagacgccgttgacgttgcccccgtccttggcccacgcgttcgcggcgtcggtcacagcgggtgctatctcaggagcggccgcgacggacagactgactgatccgctgcagctcgaatcgacgagccggctataggcgaaccagccaccggcgacggcgagaacgatcgccatcgttccgccgacgacgctcgccccttttaagttgaagtttctacgatggcggccagacacgcgctccatactgcgcaaaccaagacctgaatgccatatacgttcggtcgaaacttactcagattggcgcttgccgatctagaaaacactgagcgtagtggggccatctcgatcagtgccgctttcgagcacccgcgcgccggttgtgtccgtaaagatcacggacgtgcccgggtgcccgatctagcctatggcctgatcatcggcggactccaccgaagcagacaggtgggactcggctcaccggtcggctcgccttgcggaacgggaattccgctgtccgaatcgatccggaaaaccgttaccgtgtgtgaacgttcattggctacgtagaggtgatcgccaatcacgatcatgtgccgtggccacaccccgccggtcgatgtctcggccaccacggcagcgctctcgccgtcccacgcgaaggtggtgacggtgtccggaccgcggttggccagatagacgaaccggccgtcacgccccgcgatcacctcggacgggaagacgccgccggtgaccgcactggccgccgccgtaccgcgcagctcccagaccgggccgccggccgcccgataccagctcagcgtgccggccagctcaccggccagcagcagcgcgccgtccgcggagcgggtcaggtgccgcggtccggtgcccggcttcgcctcgacggccggctcgggcgcgcccaggcggccggagaccgggtcgagccgggatcgccacaccgtgtccgaacccagatcggagatcagcacgtcggggccggccggagccggaacgaccatgtgcgcgtgcgggcttgcctggcgctccgcgtccggcccggagccggacagggtgagcagatcgctgcgctcccccgggacgccgtccgcgtccagcggatgcacggcgaccgagccgctggtgtagttggccaccaccaggtgccggccgtccgcggtgaccgcgagatggcacgggtcggcgccgccggtggcccggaccgcgagcgggatcagggagcagtccggcgcgaccgagaaggccgagacggtgccctcgtccagctcgttcaccgcgtagagcaccgggagggtgggatgccgggtgagaaaggacggggacggcgtgcgggcagccaggcccagccgggtcagctcgccgccggccggatcacgccgcagcagcgtgatgccgtcgccctcaccccccttgtcaccggtgtaacagccgacgaagacgtactcagcgttcgcgcccataccccgatcccatcacagcgggccgacgaaacctggcaggctcctcatcttgaccggtacagaaggcgggcttactgtaccggtatagaagacgccccgaggaggtccccatggaatttcccgccgcctacctgcgcggactcaccgagacccaccgcgagctgtacagcgcgttgccggacgccccggtcgtcgcggaccggccacgccgccgctttttgcgccgggccctgcgcggcataccgtttgctggtgcccagggtgacgttgcagaccatcgcggaccgggtcggggtgagccgcatgacggtgtcgaacgcgttctcccggcccgatcagctctctcccacgctgcgccgcaagatcctggacgcggcgcaggagctggggtatgccgggcctgacccgaccgcccgggccctggccaaaggcaccaccggcgcggtcggcatcctgctcaccgactcgctgcgttacgccttcaccgacctggtcgccggcggcttcctcggcgccatcgccgaggagctcgccccgaccggcctggccatcaccctgctcacctcggccggcgccggcgacctgattccggcccgggacgtcgcgatggacggcgccctgatctactcctgcgacccggcctcacccgcggtcgcctggctgcaacgccgccggctgccgatggtcttcgtcgaccagaccccgctcgacggctacgccagcgtcaacgtcgccgaccgggagggcgcccgggccaccgcccggcacctgctcgacctggggcaccggcggatcgcctacgccatcgccggcatccacggcgcgcacggcgtgatcaccgacccgtccaccctcaccgaaggccacgcctcggtgcagcgccggctcggctgggacgacgtcctgcacgcggccggcctgcggccgaccatcatccgcgagccgttcgagcaggtcggtgcgatccgccgggacgcccgggagctcctgtccggccccgaccggccgaccgccttcctctgcttctccgacgtcaccgcggccggcgtccaccaggccgccggcgacctcggcctgcgcatcccgcaggacgtctcgatcaccggcttcgacgacggcccgaccgccacccagctgcggccggcgctgaccacggtccgtcaggacgtcgaggagaagggccgggtcgccgccgccctgctcaccgccgccctgcgcggcgagccggccccggcgccggtgatgctcgccgccaccctggtgatccgggagagcaccggcccggctccggcctagggcgcggcggtcgcgtactggcggcgcgcgacgtactccaccagctcgatcagcacgttgcgggcggccacctggtcgcgggcgtcgaacatgaccaccgggacgcccgggtccaggtcgagggcgcgggccaccgcctcggggccgaagcggtgctcggcgtcgaacgtgttcaccgcgacgacgaacggggtgccgcgctgctcgaagtagtcgatcgaggggaagcagtcggccaggcgccgggtgtcggccagcaccacggcgccgagcgcgccctgggacagctcgtcccagaggaaccagaagcggtcctgcccgggggtgccgaacaggtagagctgcaggtcctcggtaatcgtgatccggccgaagtccatggtcacggtggtggtggtcttgccctccacaccggacacgtcgtcggcgccctcggcgccggtcaagatctcctcggtctgcagcggacggatctcgctgaccgacccgaccatggtggtcttgccgacaccgaaacctccggcgatcaggatcttgagcgcgaccgggatgcgtgagccgccggtgcggtcagagcgcacggagtccattgacaaccgccttgagtacgtcgacgtcatgcggctgcgaggccgccgggggttcgtacagcgagatcagacccgccgagcgtagatcaccgagcagaacccggaccacgccgatcgacaggtcgagctgggaggcgagctccaccacggagatcggctcccaggcggccgccacgatggcgtggtgctcgggctggagctggatgccgggcgccaggtccggcacggtcgcgaccacgaaggcgaccaggtcgaagtcaccaccggacggggcgacccggccctgggtcatggcgtacgggcggacgaccgggccggcgtcctggtccatccagtcgtgactcacccgctgtccatcagaggccatcgggcgccgacagggtgcgctccggggcgctcatcgtctggccgacccgggtgaccagcatcgccatctcgtaggcgatcaggcccaggtcggcgtcggccgacgcgagcaccgccaggcacgccccctgcccggcggcggtgacgaagaggaacgcctcctccatctccaccaccgtctgccggaccgcgccggcctggaaatgccggctcgcgcccttcgccaggctctggaaaccggccgccatcgccgacaggtgctcggcgtcctcccggctcatcgcggccgaggcgcccagcatcaggccgtccgcggagagcaccacggcctgctgtgcggtcggcacccgctccacgaggtcgtcgaggagccaggtgaggttcgcgctctgcttcgtcgtctgtgccactatgcgtccttctccggccggtacacgtcattccccccggcgctctcgccgccgttgttcgcctcttcagcgtctctggatgcctggatccggccccgcgtcgtcccccgctgcagggcactcatcagcgtacgtacctgttcgggtgtgcgttccggcgcggtggagcgcggcggctccaccaccgggttgcgcagctgcggcgccaggctggcctgccggacccgcttgggcaggccgtccaggccgaactgcgcggtcacctcctcgccaccgccgtccacatcggccggtggcgccgacaccggtgcggcgaacatcggcgcggccgaggtcggcgcgaccggaagcggtggctccggggtggtgaacagcggcgcggcggaggtcggcagcaccggccccgagttgcgcggcaccgcccgcgatcccacgccgagcgcgccggccacgtcgccgagccggctcggggtcgcctccggcggcaggcccgccgtcgtctccggggcccgccggacccgcttgcgctgcaccaggccgtccggggtgagaccggaggcgaccgagctgggcgtcgggccgccggcctcgggctcggtgcggtgccggccgttcaggctctcgaccttcgccgcgggcagtgactcgccgttcacccggggtgccggcagcgccggacgggtggtggccgcggccagcggggcggtcaggtcaccggtgacctcgccacggccccgcgtgcccgccggctgcggcgcctcggtgatcagctcggccgggaccagcaccaccgcggtgatcccgccgtacggcgaggcctgcagcgacacccggatgtggtgccggtcggccagttgcgccaccacgaacaggccgagccgggcgctgtcggccgggtcgaagtcgggcggctcggccagccgccggttcgccacctcgatggcgtcggcggtcatgcccaggccacggtcctcgacctcgatcacgtagccgttcggcagcagctggccggagacctgcacccgggtgtgcggcggcgagtacgacccggcgttctcgatcagctcggcgagcagatggatcacgtcgccgaccgagcggccgagcatcgcggcggaggccaccgagcggatgtcgacccgcttgtagtcctccacctcactgatcgcgccgcggatcacgtcgatcaccgggaccgggttgcgccagccccggccgggcgccgcaccggccaggatgaccaggtcctcggcgtggcgccgcatccgggtggcgaggtggtcgacccggtagaggtcctccagctcctgcggctcggtctcccggcgctccatccggtcgagcagggacagctggcggtgcagcagcgtctggctgcgccgggcgatgttgaggaacacctcgttgatgccgcgccgcacgttcgcctcgtcgaccgcggactgcaccgcggtccgctgcacgtcgttgaaggcctggccgagctggccgatctcgtccttgccgtactccagcggcggcgtctcgacctccacgtcgaccgcctcgccgtgctgcaggcgccggaccacggtcggcagccggtgggtggccatctccagggcctcccggcgcagcttgatcagccggcccacgatggaccggccgacccgcaccgagacccagatggccagcaggaaggcacccaggccgaccagggcggacagtccgagccagaggaacacggtgatcgccagcggggtggcgtccgaggccacctcgtcgaccgtgcgcagctcgaacgcccgcaggtcggccgacacctggtcgtaggtggcctgccactcggcgccggagaccggtggcgtgcccccggtgtagctctggtcgatcagctggttctgcatgatgtccagctggacgaacgaggatccggtgatcagccgggcgtagtcgccgcgggcctgctccggcatgtcctgcacgccggaggagagcaggtagcgggaggtcgcgacgaattcgatgagccggccgcggctcttctggtcgatccggccggccgcgttcgccccggcgagcaccgcatcgacccggctcaggtactcctggccgcgatagccggcgatcaggccgcggacctcgcggtccaccttctcgtggaagaagaccgcggcgctggtggagacctcgaagccggcgtccaccgtgtcgccgtacgcggtcatcatgttcagcacgtcgatgtcgcgggtgtcgacccggccgcggacgccggtgagcgcgctcaggtcggccagcatggtgccggtccgggcggacagatcgtcgctcatccgcaggtcgcgcaccgccgtgcggaacctgtcgatcgcctggtcggtggcggcccgctgggtgcgcagatcggtcagcggcgtcttgcgggcggacaggtagacggccgagaagtgccgctcccgctggagctgggcgatcagctgcaggcccgggtcgccgagccggtgcaccgcgtcgcgggcgttgagcagatccatcgccggaccggcggtggccgcggtcgcgaagacccagagcgcgagaagcgcggcgagcggcaccgcgaccatcgcgatgatcttcgatctgatcgaccagttgcggcttctcatcaagctccgcccgaggggttcggcagggaccacggggcacaccacgggaccggaagccggccgatcagaagtggacggccggaccccggggaagatgcgcctcggaagaatacgtaaagacgtccgtcacagccagcttctggccgatggtaaaactcccttccattccgtttgtccaccggagaccggagttgatctccggttgccggccgtcgggctgccgacgacccggcgaacgcaaggtgatcatgcggtgacgccgacgcgttccgaccggtttcgtcgaacgcgattgccgatcgggtcgatgtgggaatacctcctggggaagaaggaggaacctgatgtctcccaccgccaccatcgttctgatcgtcgtcatcctgctggtgctggccgcgatcgtgttcggcgtccgggcggcccggcgccgccggttgcagcagaccttcgggccggagtacgaccgggtggtcgccgacaccggcagccgcaccgaggccgagcgtgagctgctggaacggaagaagcggcacgcgcagctggagctcaagccgctctccgcgcagtcccgggcgaaatactccgccgcctgggaggaagtccagatccgcttcgtggacagtccgaaggaggcggtggccaccgccgacgagctggtcacccggctgatcgccgagcgcggctacccgaccggcgactacgacgagcggctcgccgacctgtccgtcgaacacgccgccacgctggagcactaccgctccgcccacgagatcagcctgcgcagtaagaatgacgaggccgaaaccgaggacctgcgccaggcgctggtccactaccgggccctgttcgccgacctgctcggtgcggacccggtggcggccggcaccgcagtacccgccccgcgaccggccaccgaggacaccaccgccaccgaccggaccgcgcccaccgaacccgacgccaccagccgctgaggagcacccacgatgcgcttcttcaccaacgaggacaaggacgacaccgaccgggaggaccgggcggaccgggccgcggccttcccgcagcagcgggccggctcgccgtggaccgacgccccggccgacgagacggccgcgcccggcgcgcaccgtgacccggccgaggacgacaccacccggatcgacaccctgcggccggaccacgaggaccgggtcgcggacacccacgccgccgacgccacgcaggagatccacgaccaccgggacgacgacgaggacccggtggacgtggcgctcgacgaccgcggcaccttcgacgacccggtcgtcgtcgaggagccggtcgtcgaggagccggccgccgaggcggtccgggacgagcgcgcgggcgacgagaaccgggcgacgctgaccgagaccgacccggtggtcgccgtggccgagccgatcgaggcggaaccggtggccgagccggtcgtcgcggtcgccggcgtgcccgggcagacgcccaccgccgccgggccgtccccgttcttccccgagtcggagacccagccgctgcgcgaccgctggcgcgaggtgcagctgcgcttcgtcgacgacccgaaggcgaccaccggcgaggcggccgccctggtcgacgagaccatcgagaagctgaccagctcactgcgggcgcaccggggctcgctggccaccggggccgacgacaccgaggcgctgcgggtggagttccgggcgtaccgcgacatcctggaccgcctgctgggcctctgacgacccgcgcggaaaagagggagccggccggctccctctttcgtcgtctgtccggtggcgccggtgtccgcctactccgcggcctcgacggtgtccggggacggcgagccggacaccgctccggacccggccgagggtgacgcggaggccgaagccgacgcggaagccggtggcgccgaggccgacgcggacggggaagcggacgagacggcgaccgacggggaggccgaggcggacgccgaggtgaccaccgcggccggcgacgcgcggtggcgggcgggccggatcgacggcggcagactccaccggtcggccgggtcgtcggtgccggacacctcgccggcaccgtaaccaccctgatcggtgaccgcggccggcagttgatcgtggatcacgaccggtggccggccggccggtgtgtgatgcgtacccagctgcgcgcccagccacagcgccgggccgagcccgaccccgacgacggcgccgaacagcgccatcggcccccgctccatgagcgccacccccagttcgtcaccagcgatggtctcgcccggcacgcgcctgtgctacccgtttagggcgtacgccaagccaacaaccgctgaggacattgtgaccggaaggagggacagagttactgattcgtcgcggatgagactcgggtcttcgtcaggaaggcgaccgcgtcctcccaggccgcccacccaccgggcagttcgtcggtgtccagcgacgcgcgcagcgtgacccggccgccgtcgtgcagctcgatcacccagccgcggcgccggccgggcatcgtggtcaccgccgcgacctcgatgaacggcaggaaccggcggtcgccgccgccggcggtggcggtcaccccggccgcggcgatctcgtgcaggcgccgcctggcctccggtccccgcccccggggcaggccggggaccagcaggaaaccgaggtcggtgacgagcacgtcggtccgcccgccgtccgcggacaggttgatcaggccgccgagcacctgcgcccgggcggccgggcgggcgccgtccggcgcggccagccgcaccccgagccgggtcaggtaggcgcggaccgcctcggcctgctccggatcggcggcggccgcggccacgtcggtcaggttcaggtgggcgccgtccgcggcgaccagctcggcggtaccggtccagttgtgccgccagcgggcgacgccgctgcgcagcgcggccagcgccagggtgagcgcgagcagatcgacgatccgctcggcggtctcctccggcggcaggcccgggaagatcgtcgcggcggcggtccgcagccgcccgtcggcggccaggcgcaggatcccctcggcgtccggcacctcggcgccgaccgcgcgggcgaccgcggccatcgcggcctcggcctcacgttccatctcggccgtgcgggcgacgctgaggaagtcgtcccacgccatctcggtgcggccgtgcggcgggaaggcgacggcctgcagcgcccgtccgagcccgggcagatcgggcacgagatcctcgggggccggctgaccactttcggccggaacgtcggcggcggccggagcctcgacggcggccggggaatcagcggcggccggggaaccggcagcggccggggaaccggcagcggcctcggcagaggcgtcccctgcggccgggatcagggcggcgaggcgctcggcgagcggcggatgggtgtcccacggtccgcccggctcggccccccgggcccgcaggatcgccacatcctcgccgcgggccgcgagcacccgcaggaaaccgccgaacacgtcctccggcacatgcccggcggtccagcccggcgccacgtactcggcgtggaagagccgctgcatcccggcgagcaccggcaggtcgcgcagggctccgacggtcgcggcgaccccggcgtgcccggccgccacccggtcggcggccagctcctgcgcccggctgaacggcgcgtcccactcgcggtagacccgggcataggcccggaagacggccgcggccgggttgcggccgcggttccagcgcggcgcgatccggcccacggcgatccttccgcggtacgccgtgggagcccaccgcccgagccgggaagacccgtgtgccagttcgtgcgccaccgccgcgcgcagccgcgcggggtcccaggcgagcagcagcgggagcccgaggtagaggtcgcgccggccgccgagcagcccgagcgcccgggtccgctcaccgaccaccgcggtggcgtcggcgaccacggtcaacccggccggcggggtcaccccggcggcggccgcggccgcgtcgaccagggcccagagttgcggcgcgtccgcgcgggagatcgggaccccggccggcacccggtgccgggtgtacagggcccgccatgtggcgtagccgagcgctccgaaggtggcgatgctcagcggcaccccggcgcgtaccgcgaacgcggcgggcagcagcgtcagcaccgcccagagcacgcccagcaccgcggccagttgcaggccggccacgatcaggaagccggtcagggcgacggccgatctggtggccgctcgcgcgtcgttgctcaagccgctctcctcccaccggttcaggtaacagagggtacgggcgggaggcccggcccgatcaggccgagggccagtcgatctccggggagcggtggtagttgacgcccgccgcgtcccagcgcgggccgaaagcggccagccgctcgcggaacgccgcccagtcccggccggcctgcggggtccagccgacctcggcgaccgcgggcagccgggggaaggtgaggtactgcacgtcggcgaccgtgcgcagggtctccgaccagagcggggcggcgaccccgagcagggcctgctcgccgactccggcgaggcgggtggccgggtcccactcgtaggaccgccggaccgggaccagcccggcccagtccaggccgagcggggtgtccgcggcgtacttcatgtcgaggtaggtccggtcggccggcgacatgatcacctggtgaccggctgcgaccgcggcgagcacctgggcgtcctccggctccggccgccagtactgcaccacggtgccctcgggcaggtcggtcgcggcgatctcgtgccagccgatcgcccgcttgccgtatttgccggccagcggcagggcccgggacaggaacgcgtggtaatcctcggccgaggtggacaggcactcgtcgccgccgatgtgcaggaacggccccggggtgacgtcggcgaccgtcttgagcacggtttcgacgaaggcgtacgtctcgtccttgccggccaccagcgagctgtagccgacctcggcgtcggtgcgcggcgcgaccggccggccgtccgcggtcagttccgggtaggcgaccagggccgcgttcacgtgcccgggcatgtcgatctccgggatcacggtgacgaaccgctcggcggcgtaggccaccacgtcggcgtactcggccagggtgagaaagcccggtccggtgccgtcgcaaccggtgcccgggccgccgccgacctcggtgagccggggccagccgggaatctccagccgccagccctggtcgtcggtgaggtgcaggtgcaggtgattgatcttgaactggaccagcagatcgaggtgcgccctgatctcgtccgcggtgaagaagtgccgggccaggtcgagcatcgcgccgcggtaggcgaaccgcggccggtcctcgatcacaccgccgggcagcaccccgtcgtcggccgcgagctggcgcagcgtctgcacgccccagaacaggccggccggctcggcggcgcgcagcgacaccccggtcgcggtgatcgccagacggtatccctcggcgccgagaccgtccgtgtcggtcagttccaggcggatcggtccgtcgtcggcgagcgggcccaggtgggcggccacggcggcggccgccggcggcgcgctgaccgtcgtcaccggagtgatcgtgaaggtcacagccggttccggaaccaccagagcgggcgccgggatcacgtcaccgagccgcttcgtctgagagcgcactctgaagactctaaactgtttcgctatggcgatcactgtgcgtcatgccacggcgggcgacgagcaacctttgcacgcgctggcgacacttaccttcggattggcctgcccgccggaggccagacagacagacatcgatgaattcatcgccacccacctgtccgtcgagcggttcgccggccatctcgccgacccggcccggatcctgctgatggcgctcgacgacggatcgccactcggttattccatgctggtccgcggcccgatcacggacccggacgtggccgccgtggtggacgccgcgaccagcgtcgagctgagcaagttctacctgctggccgaccggcacggctcgggcgccgcccacacgctgatgaccgcgaccctggcggccgcggccggcaccggcgcggcgtcgtgctggctcggggtgaatcagcggaacgtgcgggccgcgaagttctatgccaagcacggtttcggcgtcgtcggcgtgaagcgtttcctggtcggcgagcagtggcacgacgaccacatccgggaactcagatttcgctgattcttatataagcgaggactgaaaattgacgccgaagtgtcgcacccgatcgataccttcatggtgcggaccggcgccacgggggcgtcggtccgtccacaggcgagtcacgtccgcgagccgcgcagcagggcctccccggccgcccgcacccggtcgtgcaactcggccggcgcctcgatggtgaacggcacggcgagcacccccagcaccagtgtgggccagcccaggtcgtcgacgttcatccgcatccggcaccggccgtcgccggccggttcgaaggtggcccagtgcccggtgaccccgcgcgccgtctccggatcggtctccagcagcaccgcgacgtcgtaacggctggggatcgcccggatccgcgcgcgcagccacgccaccgggtcgccgcccgggatctcccgcgggcggaaccgggcgccggtcagctccgggccggtgatccggtccacccggaagctgcgccagtcgccccggtccaggtcccaggccagcagataccaccgccgcccgagcgggaccagccggtgcggctcgacgtgccgccgagcggccgtgccctcgcgcgggtcgtagtcgaagcgcagccgttcctcaccgcgcgtggccagcgcgatcgtggtcagcaccgcggcgtccagcacggggccgaagccgttcgcgcccgggctggtcaccgcctgcagcgcgtcgatccggcggcgcagccgcggcggcaacagctggatcaccttggccagggcacgcaccgaggtctcctcgaagccggccaccgcaccggccgcggcgctgcgcaggccgaccgcgatcgccaccgcctcgtcgtcgtcgagcagcagcggcggcaccgcggcgccggcctgcagctggtagccgccggccacgccgcggctggcgtccaccgggtaacccagctcgcgcagccggtcgacgtcgcggcgcagggtgcgcggcgagacctcgagccgatcggccagctcggcgcccggccagtagcggtgtgtctgcagcagcgacagcagccgtagcatccgggcactcgtgttcgccatgtcaccagggtggcatcgattgcggacagcagctgaccgctaccgtggtcgcagtcgacgaaggggatggacggacgatgctcggtcgggcgctccagcggccgttccggcagctcctggaaaggctcaccgggccgcccggagcccggccggcgctgcggcacggcaacccggacgcggtcgtcgactgcgcggtctatgccggcgggctgcggcgcgccgagccggggcagccgcgccagatggcgtacgcggaagccgcccggatggcccggcgccgccgcaacgccttcgtctggctgggtctgcacgagccggaccggccgaccatggatcagatcgccgaggtcttcggcctgcacgagctgctcgtcgagcgggccaccggcggcgggcaccggcccggcgtccagacggtcggcgaggtgacccggctggtgctgcggaccgcgcggtacgtcgagcacgaccggctcaccgccacctccgaggtggtcgagacaggcgacatcaccgtgctggtcggcgcctggttcgtgatcaccgtgcggcacggcccggtcggcccgctctggcaggtccggcaggagctggagagccgtcccgaggtgctgcggcacggcccgtgggcggtggcgtacgcggtgggcagccgcctggtcgacaactacctggacgtggccgggcacgtcgagcgcgacctggagcgcctggaggaggagaccttcagcgtctcgcgcggcgccgggatcgcccacatctaccagctcaagcgggagatggtggagttcaagcgggcggtgctgccgctggccgacccgctggccaagctgctggagaccagggagctgccggccgcgctgcgtccctacctggtcgacgtgcgcgggcgactgagccgggcggtcgaccgggtggccggcttcgacgacctggtcaattcgatcctgcaggcccgcctcgcgcagatctcgatcgatcagaacgacgacatgcgcaaaatcgccgcgtgggcggcgatcgccgcggtcccgacggtgatcgccgggatctacgggatgaacttcgaggtcattccgggattggattcgccatacggattctccggcgccatgaccgcgatggccgtcctggccggcggcctgtactggcgcctgaagcggaccggctggctctgaagcgggcgcacgaccggggggaagccggccgtgcgccctcacctcccgggatcaggtcaggggtgaccaccgccctgccccggcccaccgtggccgccaccgtgcggggcgccgccggggagcgcgccaccgccgtgccgggaatcaccggtgggcccgccggggtgcccggttccgggaccgcccggaccaccttgaccccccggcgagtcggagcgcacgaccggcagcgagagcaccgcggtgcgcgtctgggtgcgagtgccgaaaccgcattcgctgtacgagatcgtggttcagagccgggccacgtcaccggcgagccggaagtccggggtcacccggacgcgggtgacctccggacgccgcggaccgagggtgcggccggtcgcgaagaaggcggcccggcggttgccggggtagtccacccggacccgctcaccgcggacctggacctgcgcgtcacagaccgggtgatcggtgcgccacgcgatgtcgacccagccggcgacggcggcgcggatcgacgggagccgggtggtgaccggccggggaccgcgcagcgccatcgggaccggctgcgggccgcggcggaccgccgggaccggctgctagctagctagggcggtgaccggtgcggccgcgaccgccgtcgccaggccggccgccgtggtggccagcgcgaaggttgctgcgattcgccgactcaggtgcatttcgaatcctccgatgcccttgtctccaccgggccctggtggaggcggcccggcacggaaggacgatatgagggttcatcagacgcttgtccgttttcgacggcgttttccggcgcgaatcccgattgggacaaatcgccagaataaggtcagccgaaaaggggatgccggccgggactgaaatcgcgtcggcggggtaacggctgcagacatgacagagaaggcggaagacctgggagaaccggtcgcctacctggtcctcaaggagggggtgccggtctacgcgcccagcggcgaccggatcggcacggtggagcacgtgctgtccgacgagccggcggacgtcttccacggcctgctgatcagcacgccggacgggcggcgcttcgcctccggcgaccaggtggccggcctgtacgagcacggggcggtcctcaccgagccggccgagcaactcgcccgctccggcgccgacctgcccggggagcgatccggaggcacgctcaaacgggcgtgggactggctggtccagccccactgacccgttcgtcgcgcgacatctacttcgaggcgcggtcgcggtacgtccatgcgccgttgccgagggtgccccgaccggtcgcgttcctcgcctgggcggcctgctgcgccatccgggcctcgatccgggcgttgaggtactcggtggcggcgcggtcctcctcgttgggcgcggaggccagcgcgtacgccatgcccagcaggccgaagaccacggtgatgccgatcgggatgagcatcgactgggcggtggcgccctcgatcacgccggagtgcccctccggggtgaccgacatcgcggacatgccggtgaagtgcatgccgttgaccgcgacgcccatcaccagggccgagatgaagatgatcagcggcctgctgaccaccagggtgagccagagcgcgacggtcgcggcgaccaccgcgatcaccaccgacaggatcacccgggaacccgagtagtggatgtcgccgtacagccgcatcgccgccatgccggtgtagtgcatcgcggccacgcccaggccggccagcacgccgccggccaggatccgcagctgccgggcgctggtgccgagcagcgcgatggccaggccggcgccgaccgccacgaacgacatcaccacgctggcgacggtgaggttcacgtcgtaccggatcggggtgccgaccacctcgaagccgagcatcgcgacgaagtgcatggtccagatgccggtggtgccgatcgccagcgccgccagcaccaaccaccagccgcgctcggcccgggtgcgcgcggaccgcaggcgcaccgcgccggtgaggccgagcagcgatccgagcacggacagcagataactgaaggctggggtcacccatccgtgatcgaagtggtgaatctccgccatggtgccgcgctccctctcccgacgagttccgccgcggtgcatcctgccccaacccccgtcgcggccgtcactgattgtgagccacgtttcgttacgagcgcacgagcggttgatctcgatttggggcagggttgagggcagatcggcttaatcggttgagtcggacatccgtttgacggagaaggccgggaatgccggactccccggtgggtcaggcgccggcgggcaacagcagccccagcgcggcggcacgctgcgagtggagcgtctgcacggtgtcctcggtgcagctgcccggccgctcgtccatcacgcacagcgtgccgacgatgtggccctccggcgagtgcagcggcacgctcgcataggaacgcacgccgctcaccgagaacagcggcgtgtccgcgtactcctcgttctcccggctgtcgccgatcagcaccggcacgtcctcggccaccacgatggtgtccggtgaccactcggccggcaccccgcccgcctcacggacccacctgggcaggccgaacgacccggccaccaccaccgtgtcgttgagcatcagggtgatcgccgcggtcggcaccccggtcagcccggccagccgctcggcgaaggcgtccaggccggcggcgtgcgccggacgggtcagcaggtccgagacggccagcagccggggcacgtcggccagctgggtggcggcatccgggtggatgtcggcgggcggcccaccgtcgacgcgggcggccagcagctcaccgaccgcctccagcagcatgcgcggacgtaccggcttggagatggtgagatcgcagaggtgccgggccgcggccggggtggccgcggacagcatgatcaggggcagtccggcggtggcggcctcggcccgcagccggtcggccacctccagaccgctcatcccgggcatgtggtggtcgaggatgaccaggtcgggcgtctcggcgccgatcgcctccagggcggccgcgccggtcgggacggtccgcaccgagtggtccgcgttgctcagcacggtggccagcagttcggcgatgtcgcggtcgtcctccgcgatgacgatggacgccatgatctgctcccctcggcctgctccccgatcgccccgactgtaaacccgcctctcccccggaatccgcggaatcagccgagtccggtggttgccgatatttgctgctcagcaacgttgtcacgcggcggtgggcgtcggcacggcgaccggatgaccggccgcccaggccagttccgccgaccggatccgtgccagcagcgccgcgatccaggccagctcggccgccaccagcccgtgccagtagccgtccgggagggtgtgcagctcggccatgtcggtggacccggccggacgcgcctcctgctccctggtgagccgctcggcccgcgccgacagcagggccaccgcccgctccgccggcagcgccccgaggcaggccaccgccagcgcgaagtcgaccgaggcgaccggtgtgtcgcgcagcccggattccacccgcgcccggaagtcggcggcgccgcggtcggtcagctcgtacacggtgcgcggcgggcggttgccgacccggcccggttcgcgcgccgccaccaggccagcccggtgcaggaacttgagcagcgtggtgaccgtgctgcgggtcggggtgagctgcgcgtgccgctcccgcaggcgggtgcccaggtcgtacgcatgcgccggccgctccccgagaagctcgagaatcggcagcaccagactgttccgtgaggcatccagcggcatgaaactacgttatgggcgtatacacctagagacaacccaatattgccctggatctgtcgaaaacgccgcagttcggcggtcgggatccttccgtagggtggctcgggtggaacccttgacgaactgggccggcaacatcaccttcggcgcgcggcgagtcctgcgcccgcagaccgtcgacgaggtccgcgagctggtcgcggccgcggccgagctgcgggtgctgggcagcggtcactcgttcaaccggctcgccgacaccaccggcgacctgctctcgctggccggcctgccgcgcatcgtggagatcagcccggaccgccgcaccgtccgcgtcgacggtggcatccggtacggcgaactcgccacccgcctgcacgccgagggcctggccctgcacaacatggcgtcgctgccgcacatctcggtggccggggcggtcgccaccgccacccacggctccggggtgcggcacggcaacctggccaccgcggtcgccggcgtggagatcgtccgcgccgacggcgagctcatccggctccgccgcggcgacgccgacttccccggcgcggtcgccgcgctcggcgcgctcggcccggtcgtcgcgctcaccctggacgtgcagcccaccttcgaactgcggcagtacgtcttcgaccacctgccggtcgccgcggtccgggccgacctcgccgacatcctcgccgacggctacagcgtcagcctcttcacccgctggaccggcaccgacatcgaccaggtgtggctcaaacgggaagatccgatcaccggcgacacgttccacggcgcgcggctcgccgacgggccgcgccacccggtgcccggcatgcccgcggagaactgcacccggcagggcggggtacccggcccctggcacgagcggctgccgcacttccggatggaattcacccccagcagcggcgaggaactgcagtccgaatggcacctgccccgcgaggcggcggacgacgcgctgcgggcggtggccgagatccgcgagcgggttgcggacgtcctgcagatctgcgaggtgcgtacgatcgcggccgaccagctgtggctcagcccgcactaccagcgggacagcgtggccctgcacttcacctggatcgccgacccggaggcggtgctgacggtggtcgccgacctggagaaactgctcgggctcctgggcgcccgaccgcacctgggcaagatcttcaccagcgcgcccgaaccgccccgggtggccgacttcgccgcactggccggacggttcgacccgaccggcaaattccgcaacgagttcctccggcggctcctgccgtgaccgcgccggccccacccgcggggcgagaagcgcttcggaggcggccgcatgaccgcccctgacggtggtgccggctttcccggccgggtcgacgcttccccctcctccacgccgcgctccgatcccgcgcagcctgctgccgccgcgccgcctgctgcggacacgccgcttgctgccgccgcgccgccggccgtcatcgcgccgccggccctcaccgtgccggtcgagccgaccgcggctgccgcctctgtcgtgatcagcgcgtttcgggcggaggcggacgcgctcgggcacgtcgcctcgcgctggaccggcgaagactggacgcgacccacccggtgcacgccgtggaacgtacgcgaattattcgcccatatccggatagttctcgcctggctgcccggcatgctggacgctccggcgccgggggcggcggacacctccgccgcggcctattaccgccccgaccaccgcttctccgcggacaccgacgcgacccgcatccgcctggcccagcagcatgcccccgggctggacgtccgcgcattccgcggcttcaccgccgacctggccgaccgctgcggcaccgaaccccccggccgcgtcgtgcgtacccgccacggcgacgccatgctgctcaccgacttcctcatcacccgggtcgtcgaactcgccgtgcacggcctggatctggccgacgccctcgcccgaccggcctggctcaccccacccgccgcggacgtggtcctcgggctgctcttcggccgaccggccagtgagctgcccggcccggctgacggcctgctccgccaggccaccggccgcgccccggccggcctcgacctgaccggtctgcggccgctgaccctgggctgaaggcttcaccctccacagacgactctgcgtctccacccgccggtcgccgcctcaccgctcaagatcctcgtgggccggcatgaaacgcagcgcccccggtgaaccgtggcagcccgcgccctgccggtcgttgccggtgaccggctcggtgaccgtgccacccggaggtgcgatgacgatccgccttacgtgacactggcctggtgaccgaagccagccccgaccagccgccgaccccggcgtccgcaccgcggcctcccgacgcggtgcccgcggcccagccaccgtccgccagcgcttcccgcccctccgccggccgtgcgggttccggcggccaagccccggtcaccgaggagccttccctggcagcgtcggcgggcgaaccgccggcagcgcaccccggcagccaaccgaccgacggcatggaccaccaacccaccgacggagcggacggccaaccgacggcgggctcgggcggtcaggcggtggtgcggcgtcggcggccgatcgtgaccgcgctctgggtggccgcgctggcggtgatcggtttggtggcctgggttcagagcaggccgtcgtcgccggatgccgagcgggatgcggcgctggacggcctgttgacgttcggtgggccggccgggtggcagctgtcgcaggatccgggggtgccggccgcggggggcttcgcctggactcagcgggatgggcggccggtgctgctcggcgacaacggattcaccgtggtctggtcggtttcgccggcgacgccggacgcctgcacggcgctgtccacctggacgaccagccggatcggggacgaggccgcgacccaggtcgccacggcgtgcccggccgccctggcacgcaaggacggcgcagagcgcgtgttcacgagctaccgcaccgatccgggtaagcacgggcgctacctgttcgccgcacgcgtcgggggcggggcgctgttcgccggtttgacctacgagcgcccgggcgcggcgcaatagcccccggtagcggccagaaacccgggagcggcgcaacaactcccagccgcggtcagaaacccgggcacggcgcaacagcccccggcagcggccagaaacccggcggcttccgacccatctgccgcggtcaggtgaccggtggtgtgcgggcgaaggctttccggtacgcggagggcgacgtgcgcatgaggtgggcgaagtggtggcggaaggtgaccgccgcgtcgaagcctacggtggcggccagtgtttcgatcgggatggtggtggtttcgagcagggccaggctggcgtggatgcgctgggcgatcagccagcggatcggggtggtaccggtcgctcgggtgaagtggcgtaggtaggtgcgggtggacatgtgggcccggcgggccagaacgtccacgctgatcggctcggccaggtgcgtgagcgcccactgcatgctgcgggccaggcggtcgtcggccgggtcgtccgggaccggggcctcgatgaactgggcctggccgccgtcccggtgcggctggacgacgaggcggcgggcgaccgcgttggcgatcgccgggccgtggtcgcggcgcaccacgtgcaggcacaggtcgaggccggcggcgctgccggcgctggtcagcacgtcgtcgtcgtcgaggtagaggacgtccgcgtcgacctggacggacgggtgccgggtgcggagggcttcggcgtaccgccagtgggtggtggcgcggcggccgtcgagcaggccggcgccggccagagcgaacgcgccggagcagatcgacatgatgcgggcgcctcgggcgtgggcggtgcgcagggcaccgatcagggccggggacgggtcggcccggacgtcgggcaccccggggacgatcaccgtctcgccgccggcgaaggtgtccagaccgtggtcggtgtgcagggccgcaccgccgatcacccggaccgggccgggggtttcggcgcagatcgtcagctcgtaccaggggcggtcgaactcgggacggggcaggccgaagacctcggtgacgatgccgagctcgaacatcgacatgccgtcgaaagccagcacggtgaccgacggcccacgccgccgcggcatcgggagcgagcactccgatggtgaagacgccggtggggcggcggccgggagcggaggcatggcgcgatcttagcggtggatggcatcagcgccactggggtcggcggggtggcgacggcacgatcaacggcatgacgaacaccgatgcgatcgcgcacttctcccgccggctggctttcgagaccgatgtcagcgacgtgcacgccgacctgagggacggcatcgctgggctggtggtggtcgactcgcgcagtgacgaggcgtggcggcaggggcacatcccggccgcggtgcacctgccgaccgggcggatcgcggcgctggcggcggagctggttccggccgggagcacggtggtcacctactgctgggggccggggtgcaacggggcgacccgggcggcgctggagttcgccaggctcgggtatgcggtgaaggagatgatcggcggctacgagtactgggtccgggagggtttcccggtgcgggacgagaagggcgaatggtcccggcccgccgatgagctcgcggctccggccggcgcgacctgcggctgctgagacccgcggaccggaaccggggtgggggcgtcagcccttgatcgcccccacgatcacgctcagtcttaccagagatcgatgcatccacgtatccccatcgcgcggatcgtcgccctcaagacacctcgtcgtcatcttgtgacgacgatgaccatgccgtgatcgctcaaatcggacccgggggtcgacaatcgccgatacgcatgaccactatgtagcgtcacttcgatggccactcgccatcgcgggtcgtacggcccgcgtgtgttccgcgggtggcaccagtcacgggggaagtatgtctgcaagaaagctgcaggctgggctgctcgcagccggcctggctgtcggaatattggtcgcaccggccgcgcccgccacggcggcacccgccgcgccggccgcggccgccgcctcggtcaccgacccgacgaacctcgccaccgacgaggacaaggtcaaggccgccggcgcgatcggcgtcaacccgggcgtcgacctgctcgtcctcaacgaccagggcttcgtcttcgccctctaccagcgcgccgaggccgggccgtacgtcaaggccgaggcgctgcgcagctacctgtcgtccgacccgcgcgcggcgtacaccttcatcgtcaccggcatcttcgtggcggccaacgacgacgcccaggccaagatcgccgagacggccgcgcaggcccgccggcgctcggtcgcggtgaccgtcgggctcgactcgtccgacaccgcgctgatcgagaagaacgaccgcgacttcatcttcgcggtctggcagcgggtcaccgccggcacccacgtctggaccaccgcccaggccgcgatcgccgacggcaccacccagaccgactgggacaccttcctgaacaccggcgcggccgccgccgccgatcaggacatgcgcgacgcgatcgcgaaggcggacgagcagctcgccgcgcagctgcgcgccaagcagctcgccgacgccaagaagtcgctgctgcagctcctgctgctgcaggtgaccgacgagctggtcaacgcgccgaaccggcagttcgtgctgttcgtccacaacaacgccaagggctccgaggtctccctggcctcccaggtcgccctgaacgcccccgacgaccagctcgacaaggcgctcagcgacttcatcttcaccggcggcgccgccgccaacaagcgcgacgaggacgccgccgcggtcatcgaacgcgacggctaccacgcccgggtcatcccgatccgcgacgccgccgagcacgacggcttctcgccgaacctgctcgccgcggcccaggcggcactggccgccaacaccctggtcgccctgcagaccttcctgctcaagggccaggacgaggcgcgcgccaaggaccgccggctggacttcacctccggattcgagaccaccgacccccggcccaactggcaggacacggtcgacaccaacggcggtggcgcgacgaacatcggcggtgtcatcgccggcctgaccaaggcggagctcggggtccggtcgttctcggacggaaccaagttcctgctctactccggcaaggacaacagcgccacctcgtcgtacagctacaacgcgctctactcgctgagcaacgtcaaggtccggccgacgaccaagctgtcgtaccagatctacccgctgagcagcgccggcgacccgaacgtgagcggcatcaacagcacctgcgtggcggtcgacatcatcttcgccgaccaccccgacctgcgtgactccggcgccaaggaccagcgcggcaactcgatccacccgggcgggcagtgcggcaagctcaagctcgacgcctggaacaccgtcgtggtcgacctcggcgcggtcgcggccggccggaccatcctgcgtgtcaacgtcggctacgaccaggccgccaacaccggcggctaccggggctacatcgacaacctgaagctcaccgacctggagagcgcgcccaagttcgtcacctccgccgagcccaccgacacccacccgacctgggtcaactcgctggacacggtcaagccgggcggcaacacgtggaacgtcggcccggtcgtctccagcgtcaccggccccgagttcaaggagggcacggactacggccgcaccgggaccggcgtcgtgctctactccggcaaggacaacggcaccgacgcgtcgtacgcctatctcaaggcgtacgcgctcaacgacacctacgtgtcgtcgacgacccagctgtcgtactggatctatccgcagagctccaagaagtggagcacggtggtcgggaacaacagcacgtgcgtggcgatcgacctgatcctgcaggacaggatcgacggctcgacgatcagcctgcgggacaccgacgtcaaggacaaccgcggcaacatcttccacccggccaagcagtgcgccaagctgccgctcgacacctggacccaggtgaccgtgccgatcggctcggtcgccaacggcaagcggatcgtgcagatcgacttcgggtacgaccaggcgcccggcaccggcgcgtaccgcggcttcctcgacgacatccgcatcacccagtaatccccgcgggtccccggcgggtccggaccacccacggtccgggcccgctgcccgcgtccacgctccaccgatgaacacggggaatctcatgcaccgcaacctgcgccccctggcgctcgtcaccgcctccgccctgctgatcggcctgccggtgacggcacagccggcctcggccgcaccgctcggggccggcccgctgctggccgccgggccgtccaaccccaccgaccgttaccgcacgctggtccgccgcctggccgacaacgacccccgctgggaggtgcagagcgcggcctggtcggcgctggtcagcgacgtgcccaccgcggtgaccgacttcctgagcagcggcggcggctacgagaaggcccgcgcccgggccaccaccgacgcctcccgcaacaacctggtgatctcgcgcgccatcgcgaccaccaccgacaagacctcgccgatcgtgcacctgaccgcgcaacgggcctcctacggcaccctggccgagaaggaccgctacgtgcggaccgggctcaaggaggcgcaggacctggacgccaagcactccccggtggagcaggccaaactgcaggcccagcaggaccgtgactacgtgaccgacatcgccgcgcacggctccggcgcctgggtgcgggcggccgcgcagcgggcgatccagaagggcaccgacaacgacatcgccgagttcttcaagtactcgtgggcgtccgcggcgaactgcgacctgcaggcctaccggatggacctggtggagcaggacctgacctaccggcaccgcctcgaccagctgatcgccgccgcccaggccgcccagcaggcctacgaggcggcgtccgacgcggccaaggccaaggctgccgaagaggcgaagctggcctggaacaccgcggccgacaccgcggccgccacccaggcgtcctggctggccaacagcgccgccgcggcggcgcaggcgcaggcctgggctgcggtgcacgacttcgcggtgaccgcgtccacccagcaggactggccgacgatcgccggcaacgcggcgaacaccgacgcatcctggaccgacgaggtggcctgggcgcagaaccaggcgcaggagtggaccgcgctgtacgagtcggccaaggccagcgccgaggcgatcccggccgcgccggcgaacggcccgagcgcgtcaccggcggtctgaacaggacgaggcctgggcagctcccggcccgcagcgccagcgggccgaacacggcgcggtccaggcaactccgggcccgcgtcgccagcgggccgaacacggcgcggcccgggcagctccgggcccgcgtcgccagcgggccgaacacggcgcggcccgggcagcttccggctgtcgtggccggggctgcccaggcaggtcaccgcccacccggtggcgggcgggatggcgagagttgtccacaggtcgcgagaaacttgcgcgagtggccctggcggtctggcagggtcgggttcatcggtggcgggcggtctgcccgccaccgggcggaccatggagggtgcgggcgatgacctcagcgggacaggcggcggcattcgccggagtgatcgcgctggccgcgatctcccccgggccggacttcgcggtggtggtgcgccggtcggtggtggccggccgccggcacggggtggtggccgggctcggcgtggccaccggggtgttcgtctggtcggtggccgcggcgatgggggtggccgccgtcctggaggcgtcggccgtggccttcaccgtggtcaagctcgccggcgcggcatacctgttgtggctgggcgtgaccgctctgctcgccgcgcgccgaggcggtgccgccccggagatcaccaccgaccgggacacggacgtgcggttgtgggtgtcgtaccgcaacggggtgctctgcaatgtcttcaaccccaagtgcggggtcttcttcatggccgtcctgccccagttcgtcccgatcgacggccggccggccgacgtgctgctgctgtcgtcggtggcggtgatcgtcacgatcagctggttcaccgtggtcgccaccctggtcgccgcgctgcgacgggtgctggcccggccccgggtgcgtcgcgcggtggacgcggcgaccggcgcggtgctggtcgcgctcgggctgcggctcgcgaccgccggcgcctgagattgcgcgccggtcgtaacgtggactgatcatgggtgacaacgaggacacgggtcgggtcgggaaacagatcggtgggacggtcgccgttgctgtcctctccgcgctcagctggctcgcctggatgggctgggaccacgagtatcagacggatccggccaccggcgtgaccagcgggccgtacgaagcctggcaggtgatcggctgcgcgctgaccctgctcgcggtcttcgccggggcgatggccgccggggtgcggccggtgctggtgtcggtggcgctgccactggccttcaccgcggcctggacggtcaccgccgccgccgacgacaccaccgggctgtatgcggcgggcgctctcctgctgctgctcggcctcggcgcggcgacagtggtggcctcagcgatcaccgcggcgatccgacactggcgagccgccccacactgaccctgtccgccgacgctccacccgcagggcgccccgacggcccaacgccccgacggcccaacgccccggcggctcagcggtgcggcggtattcggcgagctggcgctcggcggcgtgtttcggcggacggcggcggtcactgcctttcggccggcggcgctcaatggcccgctgcctgtggaccagtggcgaagtagcctgccggacgtggcaatccgccgcgggcatggaggctcagcaggttggatcgagtttctggtcggaaccatggtggcctgtgggcatggatgcgggccatctccggccggcggggggactgacgcctcgccgggatggcccgcggtgtccggccgcgcgccccgccccgtcgtcgaaggttcccgccatatcgccaataggcgaacactccgtgttctgcgcacggagtccagtactcggtgcattccgcaaaaaggccgactcgcggaatgctgaacctttcccggaactaattgcggcgggcgttgggcgggctcagcacggctctcacctgcagtgatgcaagttgcataccgttcgtctaacgaccctcctttctggaattggcacactgttttcccgggtacgcattgtcccggagctattgcgcttcgtatggttggtcaactgtcatcgatcgacttaagtgcgacgaagcggggcagccatgctgatcaaagtcatcgaccagatcaccgacggtgagatgctggaggccgcgtggggtctctacctcgaggcgttcgaggatctcaactcactcgcggtgcagcggcacctgatgtaccggtcggagttcgacgaggtgatgcgggaccccagggtcgacaaatacctcgcgttgcaggaggacggcacgctcgccgggctctcctgctacacgaacaacctggacgccatcccgttgatcgcgcccgcctacttcgagcggcactatccggagcactaccacgccaagcggatctggtacatcgtcttcgtcgcggtgaagccggaagcgcagggccaggacgcgttcgcgcagatgtcggaacagatgtacctggtcgcggccacccagaacggcctcgtcggcctggacgtgtgctcctacaacgatgacgtgcggcacatgtcccgggtgttccggctgctgatcggccggctgtgcaatttcaacatgacgttccagcagatcgaccagcagtcgttctggctctacaacttcccggcagtcgcgtcggagaataccgtcgacatcccgcgtgcggcgtgagggtcaggccataggcgcccgccacatcgtccacaacggaggcccgccgggcaggttgatgacggaacggatctggtagccgtggcgaaggtacaggtcacggttacgcgggtcgttggcctccaggtaggccgggaggccggcctggtccagccgggcatggtggcgctcgagcagagcgctgccgatgcccctgttctgcgagtcggggcggacggccaggaacgccaggtagtggtgcggttcgagcgggtggtgctcgtccagcgtgacgtcgagctggcaggcgcggtcgaaggcgtcgccggccgcctccttgagccggcgctcgtagtcgaccggcggcgggatcagcgacgtgagcgggaaccacagcgccacgccgtcgagccggccggtctccgagtcggcggtggcatagacctcgccgtaccgggtcgcatgctcgacgaagatctcgaagtatcgcggagcctcccgccggcgcacctccgggtcaccgtgcagccacttcgccaccgggccgtcacgcatcgcctcggcgacgagatcggtgatctcgtcggtgtcaaccggggtgacatcccggatgaccaattcctggatggcgtacgtcatcggattcctttctcaagtcgaaccctcaccatgaggggtagccacgcgaacccaccggcgccggaggcagcacgtgcggggagaagtcggtctcgagggccgggaaggcgacccgggtttcggcgccacgaccgatcgccgcgtacacgtcgggccgggtcctgcgcatgatcagggcccaggagaagccgatcagcgcgacgacggcgtaggccaccggcacgatccagttgaagatggagccgctggacacctgcagcagctgaccgaagccgatgatggtcgcggccagcacgatggagagcagcaggaaggcgatgaacggcgccaggtaggcacgccagacactctccccgcgccggccgcgctggaagaacgcgatcaccgcggccgaggccgaccacatcaggatcagcacgcccaggccgccgatcgtggtcagccacgcgaacaggtacagcaggggctccaggccgacgaccgcatagatgctgatcacgccgagtgccagcacgctctgggtgatggcgccgaccagcggggcaccggtgcgcggatgggtgtaaccccaggccgacggcagcacaccctcccggccgagggcgaactggtagcgggcgacagcggcgtggaacgccagcagcgcggcgaagacgctggtcatgaacagcacgtaacccacgtcgacgagggccaccggcaggtgcggggagaccagccggaacaccaggtcggtctggtgctcggcggccaccgcggtgatccggtccgggccggtggtgaccgacatcgcccaggcggagacgccgcagagcaggccggccagcaggaccgcgatgtgcgtggcccgggcgatggtccgcttcgggtccttggcctcctcggagagtacgacggtcgcctcgaacccgacgaacccggcgatggccagcaccagcagcgaaccgaccacgggtgtcagcatcggcgccggggagagcgtcgcgaagctgacgtgaccgccggccgggtgtgaaaccatcaccaggtcgtagagcagcacgatggtgatctcggcgaccagcagcgcggcgagcaccttgccgctgaggtcgacccagagcatgccgagcacggtgaccagcacccaggcgccgatggcgcacgcgtaccacgacacctggagcccgaactcggcgaagatgccggacgcggcggtgccgaagagcccgaagaggccgatctgcatcagtgaatacgccggcagggcgacgaatgcggcgccgacgccgaccacccggcccagaccgtggctgatgtacgagtagaacgcgccggagttcacgatgtgccggctcatggccacgaacccgaccgtgaacagcgacaggataccggccaccaccaggtaggcgaccgggaccgcggtgctgccctggatcgcgtagatcgccgaaatggatccgatgatcacggtgagcggcgcggccccggcgacgccgaagaagacgaccgaggcggtgccgagccggttctgggccagcgcccggctgatgatgtccggctcggcggccgatttccgctgggtcaggagccgaccggcccactggtcggtgttgttgtgccgcagctggtgccgtccgacgctcatcgacgccccacggtcagcaccgatccgatggacgcctcggtgtactccacgatttcccgcaggtcgctcggcaatccgaacgcgacgttcggcacgtactggaaggcgtgcggatactgttcgaaaccatagaggacgtgccgggtcaacccggtcgcggagacgaggctgaccagcatctggtcgacgatgctcagctccatgccgcggaccaggagattggccagccgggtggaggcccaggccgcggcgttgcgctgctgcgccgagttcggcatgtaggtgaccgacggggagccgagcatgcgacggcggacgatcggctcgaccgcgccgatgcgcatcagtcgctcacccacccgcaatccggcgtcctgggagagaaaggcgagccaggtgcgcacgtcacgatgctgcggctgggcgacgagaagatcgagaatgtcgtgctcgagcgcgtccgccggcggatggcgatcaagaacgaaaaggtcgccgtcggtgacgccgatgcggccttccaggacgagttcggagagtaatgcggcggccaacccaaggccggtcgcacggggatgtagcctggaccgcccggtgcggtcctcgtgtgcgatcaggtagtactggtcagccaacacttgcgccacgccccttagacgccagttccaatgatcatttcgcctatgtagcaaacaagacagaactcgatgtccgtcgcatcatgtccccaacagcaaggtcaatgcaagaagtactagacttcttattcaggccccgccgctgagcacccactttgatgatcatcaattgtcgatcatgaatgggggttacgcgatcatgaggaacgctcgtaatatcagcctcctcagcacctttagggagtcttaggtgtccgatattgagggtccgacactccgccgccgccgcctcggggtggaactcaagcggtgccgcgaggctgcccatttgacgcagcaggacgtgtcgcggcatttcgagtggcactctgcgaaggtgacccggatcgagacggcgcgggtcgcggtgacgccgcgcgatgtccgagatctactgaccctctaccgggtggaggacgatacctaccgcgaggctctggtcgagctggcccgctcgtcccgggagcgcagctggtggaccgactacaaggacatcatgcggccgggcaacttcgtcggcatggaggccgcggcgacgtcgatgcggtgctgggagccgatcatcattcccggactcctgcagacggaggcgtacatgcgcgctctgatcagtaccggtcgatcagccgacccgccccagcgcatcgacaggcgcatctcgctgcgattgacgcgccagagccggctgcacggcgaccacccgctggagctggctgcgatcgtcgacgaatcggtggtgcgccgcgtgatcggcggcgaagacgtgatgcgggcacaactcgaccatttgatagaaatagctaaattgccgaatgtctcattgcagatcttgccgttcggatccggtgaacatccgttcctgggcggcgccgtcacccttttggaataccgggataccacccatttggatgttgtctacctcgaaggcattgcgggagactactacgaggagcagccgactgaggttgcccggtacaggcaggagttcgagcgattgagcaccagggcgctcgaccatcgcaccaccataaagatgatcgagagtctgctcgtcgcctgacgactcccgaatcaatctcatattggagggaggtgcacgagttgctcgcgcaccagctcaacggtgccgtctggaagaagggcagtcgtagcaacggcaacggcggcaacaactgcgtcgaggtcgcattcctcgacgaaggaggaatcgccgtccgtgacagcaagaaccggacaggcccagctctcttgttcacgccggcggagtggaccgccttcgtggactctgccaaggacggcgagttcgatatcgctccgtgagcctaccgataggctcgcaccgatggaagagttcgactgaaccccttcggtgcatgatctgaaaaggaagccgcaacacccggccgggtgttgcggctttctgtatggtcgtcaacagtcagcattcaccaccgttgacatagacctatgccgatgcgagggtacgtgcacccaccggccggaccggccgacgtgggattccgtcgcctgacaagaagggacgaccctcgcatgcgcctacgtcgcgcagtcgccgtcatggccgccgcagtcgcggccaccaccgcggtcctcgccggacccacccccgcccgggcggtcaccgcggtcaccctcgccaacacgatcaagctcagcaactgctcggcgtcgctggttcgctaccccacctcggtcagcagcgaccgggcgatgatgctcaccaacggacattgttacgaaggtggcctgatcccgtccggcaccgtcctgcagaaccgcaccagcagccgctccggcaccctgctcaacagcagcggccgggccgtcgccacggtgcgcgccgaccgcgtgctgtacgccacgatgaccggcaccgacgtcaccctgtaccgactgaccagcacctacgccacgctgtccagccggtacggcgccaccgcgctgaccatttcggcgaaccacccggcagccggatccagcatcgtcatcccgtccagctactggaagcggatctggaactgcacgatcaacggtttcgtgccgaccctccgcgaagacgaatggacatggcacgattcgctgcggtacgacagcgcctgccaaaccattcacggcacctccggatcgccgatcgtcgacgccaccagcggacagatcgtcggcatcaacaacaccggaaacgacgacggcgagatgtgcacgctgaacaacccgtgcgaggtcgacgcgaacggcaccacgcacgcatacctcgggcagagttacggcgaggagacgtactggttcaccacctgcctcaccggtacccgcaccatcgatctgaccatctccggctgcctgctgaccaaaccgtaggcggcccgacccgcgtccggccggtggtcccccggccggacgcggcccatgaagatgccccgatgcgatccgatccgccgtcgggcaccgtgatcccgccgctcccggccgtcgccattccggatcgccatttgccggtacgccgtcagccggccgatgctcctgcgcaccgcaccgcaccgcaccgcaccgcaccgattcccggtacgccgtcagcaccggagccgcgcgccgaccggccaccgggatcgggcaggagccaccggtcgccccgcccggcggcaacggtgagcagtagcggacatgcggaccgcgctccgggacaggctccagagaacagggacgctgcggaacaggcgccgggacacttttccggcccgacctgatcgacgccgcccgcggatgtgggatcaggcgacgcgggcgaccggggccgggtgggtggtggccgggatgatgatcggctcggtgggcagcaggtggtgaaccgcggtggcgtgggcagccgcgaggatcgtctcctggcagaggctctgccagttgcggcgggcggtctgggcgtcgcgccaggccagtttctcggcggcggcggcacgcttccagacagcctccaggtgggtcgccgcggcacgctggatgaccagctcctggtcgaccgggtgcaggcgggcgtcccatccgccacggccggtcagggcgtcggcgacggcgctggtcggcagttcgccacgctccgcggcggcgcggaccgccaggtgcaggaaacgctcgcggtcgacatactcggccgggctctgctccgtggccggcgtgccgtaggcgatcgccgtccggctgcgctggagccgcgcgtcggccgcctgccaggcacggaacgccgcgtcgacccgcgcggcggtcgcctcccagtgctcctgccagcggtccgcggcgtacccggcctgctctgccgcgacccgcacctcctcggcgtagcggaccgaccgcaccgcctcggtctcccgccggaggcgttcctcccgccgcgccgcggcgcggtggaagaggcggcgcagcagtggccgccgccccgacgcccggctcgccaacccggcgtccccctcccccgcgtgaccggcgaggcccgccgcgtggtggcgacccgccgaagaaccccgcgccgcgaaagacgtcccctcctgcgcggcaggggcggagacggccgggaagcccggagtgacgtccgccgggacttctctggcggggtccgcggagctgaaggtggaggcgaggcccaccggaacagagggcgctgagcctgccgagctcagggaaggggcggcgctggctgtggcggaatccgccgagcccagggaaggggcagcgctcgctgtggcggaatccgccgagctcaaggaaggggcggcgctcgctgtggcggaatccgccgagctcagcgaaggggcgccgctcgctgtggcggacggggtggaatccgcggagtcggcgaatggagcaggccctgccggggtggcgagggaggggtccccggaggtcagaaacgggatcgggtcgccggggaagaaatcgttggtggggggttcgcggcggcgggggtggcgcagcgggcggccgatcaggaacgcgcccgcgtcgatgagggcctggaccgggttgcggactccggtggggctggcgaggaccaccatcgccgggatggtggcgagccacagggccgcccagatagccaccggggccggctcgtgcagcagcatttcggcaagcatggtcatgaggtttcgtccgttccgctcgtctgagatctccgctggccaggcacacgtacacgcgacctcgcggacgaccgggacgggcgttcgcggggttcaggcggcggtgcggggtggcgctcgggaacccgcggccccggccgatcgctgcgcgcacagggcgcgggtgcgatcggcgacgcggcggccggagaccggtgcggcgagcggagcggaaacctcgaccggaacggcggccggaacggcagccgacgaggcgaaggccggtgcggcgaccggtgcgggtgcggcagcggccgagacggcggccggtgcgggtgcggcagcggccgagacggcggccggtgcgggtgcggcagcggccgagacggcggccggtgcggcgatgacgaacgtgtccgcgaccggaacagggacgccggaccggcccgatgcgtaggcggtcgacccggcagcggtcggtcccagcgcgaccggtgtgccggcgaccggatgggtgctggccgcgaagaaggccaggaccagcgcgaacagtgcgggcaacgaccggagcaccgaactgcggtgcgcggtcgtggtcatgactgtcaaggtatccgcccgtttcggccggccgggggaggcggcgcgccgcaccgccgggttcacccgcaggtggcgaggccgcgagtcagaagcacacaaagtgggggagagccggaagtggggagaccgggaatggggagaccgcgagtgaatggggccaaacgagtaagaccaggcggggggaccgccgggtgccgggagccggggccggggtggacgagccggcgggggcccgggccggtccctcgcccgcgtggaaccggcccgggtcgtcgaggccgggcagcggcacagattcgggtaagtatggggcacttccgggcgtagcggatgaatattaaacgcgatttaaagcttcgctcacatcgccgccggagtcgccgatgggatcgggaacgtccacgacgggagcgatcatgcggatacgggccggtgccgccgatcctgtgctggtcggtctgctggtgctgggtgtgctgctgtttcccctgttcctcaccgggctgggcggggatcgcgcgtcgtggaccgtgcagaccgcgatcgacctggccgatgtgctgttcgcctggcggctggcccggcaccccgatgtcccaccggtcggccgccgtttctggcgggctctggtcgtcgcctgcgccgcctgcaccgccggcgacagctttcagacgatgctggcgtacgcgggatccggcgcccagatcagcatggtgcagacgattctcgtggtggccggcatggcgatcgtggtggtcgccatgctgcgccatccgctgggcggggagggccggcagcgactgcggttgtggctggacgccgccacggtgctcaccggggtggccgtcttcctctggtactacctgctcgccgacgagtggagcggcccgcaggagatgcaccgctggggtgccgcggcgaccgccggggtgatgttgctgatcgcgtttggcgtgctgaagatgctgttcagcggcacggcgccgttttcccggacggcggggctgctcgggtgtgtggggctggccggcacggggccgggcgcggcgctggccggggtgctggccggcggcgagatggatcccggggtgatgtatctggtgcagctgctgccctgcctgatcatggcggtggcgttgcggctgcagctggtgcagagccggccggtggatccggcgcgcgcccggcgggtggcgcagcgaccgagtgtgctgccgtacgtcgcggtgatcgcgactcaggtgctggtcgtctcggcgctgcggggtggccggcccgggctgggcacatggggtgtggcgatcggcgcggtggtgatcacggcgctggtgctggcccggcagttgtccgcggtgcgggacaacgaacggctgctcatcgagctggatcagcagcgggagtggttccgggcgctggtgcagcacacgtcggacctgacgctggtggtgaagcgggacggcaccgtgcagtacgccagtcaggccgcggaccgggtgctcggactgagcccggcggagctggtcggcacgtcgctgcacgatcgcacgcacccggacgaccgcgcggcggtggatcggctggacgagcaccagagtgcgcatccgggggagagtgtggctttccaggtgcgctggcggcatgccgacggcacgtaccgctggctggatctgatcagcaccgacctgtatcacaatccgcatgtgggtgccgtggtgctcaatgcccgggatgcgaccgagacccgggcgctgcacgacgagctgcagcggcaggcgacgcacgacgcgctgaccgggctggcgaaccgggtgttgctgcagcggcggatcgacgaggcggcgggcgacgacccgtacgagacgagcatgctcttgatcgatctcgatggtttcaaggcgatcaacgaccggcacgggcatcacgccggggaccgggtgctggtgctggtcgccgagcggctgaccgcgctgctcgggcccggcgaggtggcggcccgcctgggtggcgacgagttcgcggtgctgctgcccggaaccggggcggcggaggcggcggcgctcgccgagcggatcaccgcggtggccgccgaacccatgttgatcaatgggcggtggctgtcggtgggcgccagcgtgggggtggcgtccgggcgggccggcgagggcgaccggctgctgcgcgaggcggatgcggagatgtaccggcgcaagcacgaccgtagggccgcgatcggctgactcagcgtgaccgtcgttgacgcggcctgtcaccctgtggaccgctgaccggggagacgggacgacagtttgatggggaacggattcatcgaagccgcgctgagcttcccgaccgttctcctgactccgttgctgatcctcgtgatcggctactggatcgtggtgatcgtgggcggcgccggtccggacgccgggcacgatcacggcgggctgctcggcgtgccgctgccggtgtccgtctcgctgctggtggcgctcgcctggttcggcacgctggccggcagccagtggcccggaccggtgccacccggggtgatcccgccggtcgcgctggtcgcggccgcgctggtcacccggctgatcgcgatcccgttgcgccggctgctgccggacggcccggacgcctcgcgcgccgatttcgtcggccgcacctgcgtgatccggaccggccgggtcaccggcacgttcggccaggccgaggtgcacgccgaggacggctcctcggccatcatccaggtccggcagaccggcgtggacgcgttgcccgccggcacggtcgccctcatctacgacgtcgacccggagggcgagttcttctgggtcgttcccgccgacatcgccaggaaaggcctttgatggatgtggtgtccaccggtttcggtgtgcttctcgccgtggtcgtgctcatcgcgatcggcgtgctgttcttcctcagccggatgttccggaaggtggagcagggcaaggctctgatcgtctcgaaggtgcgccgggtggacgtcaccttcaccggcgcggtggtgcttcccgtgctgcacaaggccgaggtgatggacatctcggtgaagacgatcgagatctcgcgcaccggccgcgagggcctgatctgccgggacaacatccgggccgacatccggatcaccttcttcgtgcgggtcaacaagaccaccgaggacgtgatcaaggtggcgcaggcgatcggcaccagccgggccagcaacgaggcgacgctgcaggagctgttcaacgcgaagttctcggaggcgctcaagacggtcggcaagcagctcgacttcgtcgatctgtacaccaagcgcaacgacttccgggatcagatcatcgaggtgatcggcaccgatctgaacggctacagcctggaggacgcggcgatcgacttcctggagcagacgccgctgggctcgctggatccgaagaacatcctggacgcccagggcatccggaagatcaccgagctgaccgcgatcgaggcggtgctcaccaacgacttccggcgcaacgaggagaaggagatcacccggcaggacgtggacgcccgggaggcgatcctcgaactggagcgccgcaaggcggacgcggagatcaagcagcgccgcgagatcgagaccatccgggcccgcgaggaggccgagatcgcgctggcccgggccgaggagacgctgcgctcggaggccgcccgcctcaagaccgagcagcagctcggagtgcaggcggagaacaagaaccgggagatcgcggtcgccgagaagaaccgcgagcgggtgatcgcgatcgagaccgagcggatcgagaaggaccggatgctcgaggtgatcggccggcagcgggagaccgagctgtccacgatcgccaaggactccgaggtcgagaccgagaaacgggcgatggccgaggtgatccgggagcggatcgcggtggagcggacggtcgccgagcaggaggagaacatcaagcgcctgcgggtggtcgaggaggccgagcggacccggcaggcggtcgtcatcaacgccgaggccgaggcgcaggaggcgctggtcaaggacatcaaggcggccgaggccgcggaggccgcggcccggttcaaagcgcgcgagcagctgctgctggccgaggcgaagcagcaggccgccgagctggaggcgcaagccgcgatccggctggccgagggcaagcaggccgaggcggccgcgttcggcctggccgaggtgcgggtccgggagcgcaacgcggaggcgatcgagaagaccggccgggccgaggcgatcgtggagcgggagaaggcactggtcgccgccgaggcgatcaaggagaagctgaagggcgaggcggagggcctggagcagaaggcgtccgcgatggccacgctcgacgaggtcacccgggcgcacgaggagtaccggctgcggctggagatggagaaggagatccggctggccggcatccacgtgcaccgggagatcgccgaggcgcaggcccgggtggtcgcggccgggctggagaaggcggacatcgacatcgtcggcggcgactcggtcttcttcgacaagctgatcggctcgatcacgctgggcaagagcatcgacggtttcgtcgagcacagctcggtggcgcaggcggtcggcgcccgctacctcaacggcgacggtgacctcgccgaggacctgcgcaaggtcgtcggtgcggtgtccaccgcggatgtcgccaacctgagcgtcgcggccgcggtggccaactccgtcacgaaggacaagtctgagtgaccatcgacgcgggcacgtacgaggtgctccggggccggctcgacgccaaggcgcgcgagctggccgggcgggccgagacgctgaacgcccggcggatcgaggccttcggcgcccagcagaccgaactgctgggcaccgagcggatccgcaccggcaacaacgcggtgccggccgacgtcgcgccggccggggaggtgctgctgttcggcgccaacgcgttcctcgggatgaaggccgagaccgcggtggacgacgtgttcaccgtggtcgaccggaagttccagccggccgcggcgccggggctgctggacgatccggggttccgccgtgacttcgccgagctgtaccggtactaccgggggacccggctgcggcagctgcgccgggtcgagggccagctgctggcgatcttccagaccggggcccgggccggcgacctcaaggtgctgcgctggcagatcggcgtggacggcacggtcgcgtatcaggacgcgcgcggcgagcgggaccacgtgctgccgcccacgcacgacttcgagtggacggtcaccagccgcgagcagcacgtgctcggccggcacccgcacgtgtcgatcgaggacgaggtgttcgtcgagacggtcggcggcgacctgaccgtcaaggtggaggacaacaccgaggacggcgcgggcgtctactcggagccggtggaccagccgctgcagagcctggcggacgcggagatcgcgtacgcccgggtcgggccgttgatccttctccgggtgctgccgtatcaggagacggcgtaccgctacctggtcttcaacacccgcacccgggatgtacgccgcctggacgggatcgggcaggcgtgccgccggctgccggaggaccagggcgtcatcttccccggcgggtactacctggtgaccggggcggccaagacattcgaccgggacaccgccgggctggcgttcgagcgggtggtccggtcggtcaacggcgaggacgtgctgcacgtcttccacgacgccgattccgggcggtatctgctgctgccgtacaacgtgatcggcaagcaggtggcgacgccgatcaccgggcacggctacgcgatcttcgacgacggcaccctggtggtgctccgctcccccggcgacgaaccggcccgggtccacccggtgcaggtctggcgcacgccgtacgtctcggacgcgcacgccgcggcccagccggccgggaccgggccgctggcccggatcggcaacgccgacctggtccggggaatcgccgacgcgctcaccgtgagccggatggtcggcgagatgtcggcggccgggccggtcttcgaggcgatcatcgcggcctgcacccggaccttcgacacctatcactggctggccgacccggagctggagaatctggccgagccgctggccgaggtgcgcgccgcggccacccgggtgctcgacgagttcgccgcggtgcaggcgctgaccgcgcaggccgagcctagctagctagagctgcggcgtgagcgcgggcggctggccgggctgcgcgagatgcggtacgccgacggcgcgcggctggatgccatcgacgcgtcgctggtcaccgcgaccgacgacaccgcccggcgcgcggtcgagttcctgcgccaccccgacgcgttcgccgactaccaggcgagcgtcgaggagctggccgggcaggccgcggcgatcggcacggtggccgagggcgagccggtcgccggccggatcaccgagcagtccgacgggctgcaggtggtcaccgaggtggtcggcggtctggagatcgccgacgccaccgtgcgggtgtccattctggaccggatcggcgcggtgctgggcgggctcaaccgcgcccgcgccacggtggacgcccggcgccgggagctggccgcggtcgagggccgggccgcgttcgccgccgagttcgcgctgttcggccagtcggtctccgccgcgctcgccgccgccgacaccccggagcactgcgacgagcacctggcccggctgatggcccaggtggagacgctggagagccggttcggcgaggtcgacgacttcggcgagcggctggccacccgacgcgccgaggtgtacgaggcgatcgccggacgccggcagtcgctgctcgacgagcgggcccgccgcgccgaccggctggccggctcggcccggcggatcctggacgcgatccaccgccggatcgccacgctgggcgatccggacgaggtgaacacgtacttcgccaccgatcccatggtggccaaggtccgctcggtcgccgaccggctgcgggccgacggcgacccggtccgcgccgaggaactggacgggcggctcacggcggcgcggcaggaggccgggcgggcgctgcgggaccggcgggagctgttcggcgacggcgggatccggctgggacggcacaccttcgcggtcaacgggcaggccatcgacctcacgctggtgccgcacgacggcgggctggcctacgcgatcaccggcaccgactaccgcgcgccggtcaccgacgaggcgttccagcagacccgggatttctgggaccagccgctgatctccgagtatcgccgcctgtaccgggcggagcacctggccgcggcgattctcgccgaagaaccccgggctgcggccaccgcacaggccgagggccggttgcgggagctggtgcaccggatcgccgattcgcggtacgacgaggggtacgagcggggcgtgcacgacgccgacgccacggtgatcctcgacgcgttgctgcggatgcacacgaccgccggcctgctccgctacccgccccggatccgggtcgccgcccagttgttctgggcctacggcgccaccgccgggcagcgtcaggcctggcagctgcgcgccgcgtcgctgatccgggtccgggccatgttcggctccgccggccgggccctcgacgacctccgggccgaactgaccgacgccgccaccgatcacctgggtacggccggcctgtcggcggcgggcgtggcgaccggggacgcggagatcggcgagtatctggtcgacgagctggccggcaccccggccgggttcgtcaccggcgccggtgcccgcgccttcctggaccgcttccaccgcgagctgggcggtgcggagtccgcgccggcccggcagtacgccgaggacctgcgcgccctggccggcgagccggccgtccggcaccagctggtgtacgcctggctggaagccttccatcgggcccggccggactccggcgacctgaacgacatgctggaggcggtgggcatcgaggtcgtcggcaccggactgacccggtacgacgtggccgcgacggtccgcgagacggtcaccgggctgctcggcgtgcacccgcggatcaaggacgggcagctgacggtacgcctcgacgcgctgctgtcccgggcccggcacttccgggagaagcggatgccggcctaccgcgactaccagagccggcgggcggcgctcgcgaaggccgaacgggcccggctgcgactggacgagttcaagccgcgggtgatgaccaccttcgtgcgcaaccggctgctcgacgacgtctatctgccgctgatcggggacaacctggcgcgtcagctcgggacggccggggcggaacggcgtaccgaccgatcggggctgttgatgttgatctccccgcccggttacggcaagacgaccctgatggagtacgtggcggatcgcctcggcctggtcttcgtcaaggtcaacgggccggcgctggggcacggcgtcacctcgctggacccggccgacgcgccggacgccaccgcccgccaggaggtggagaagatctcgctggccctggagatgggcaccaacgtgctgctgcacctcgacgacatccagcacaccagcccggagctgctgcagaagttcatctcgctgtgcgacgcgcaacgccgcatggagggggtctggaacggccggacccggacgtacgacctgcgtggcaaacggttcgcggtgtgcatggcgggcaacccgtacaccgagagcggccgtcgtttccgggtgccggacatgctggccaaccgggccgacgtgtggaacctgggtgacgtgctggccggccgggaggacctgttcgcactgtcctatctggagaacgcgctgaccgcgaacaccgtgctggccccgctggccgctcgggacggcgccgacctgccgctgctgctgcggctggccgagggcgacgagacggcccgggcggaccggctggcgtacccgtactccgccgccgaactggagcagatcctggcggtgctgcggatgatgcgccgggcgcagcgggtggtgctgcgggtcaaccaggcctacctggcctcggcgtcgcaggccgaagccggccgcaccgagccgccgttccggctgcagggttcctaccgcaacatgaacaagctggccgagcggatcgtgccggcgatgaacgacgacgaactggagcaggtgatcgacgactactatctgggcgaggcgcagaccctcaccggcggcgccgaggccaacctgctcaagctcgccgagctccgcggccggctggctccggcgagagccgcacgctgggccgaggtcaaggccgcgtaccggcgggagcagacgctcggcggggccgaggccgacccggtgacgcgggctgccggggcggtcgcgctggtcgcggaccgcgtggccggggtggaggaggcgatccggctcaggacacgggcagctgcgtggacagctgagcggcctgaccggccagcgcggtgaagccggcgtcgctgatcttgccgtcgtcgtgcaggtcggcgagcttcttggcgaacgacttcagctgtttgccggcgccctcccgatcgtccttgcggagctcctcggcgatcttgcggagccgggtgttcaacgcccgggcgtcgtcgcgctccagctgacggctgcggaacaggacgaacacctcgccccgcatctgctgcagcacccgggtgagctgagcggccgagacggccggcggccggctgctgggccgggcgctgctcggcttcggcgacggcccggtgctcgactcgatcagcggctcgatgctggtggtctgcagcacctgggccgaggtcgccggggcggccgccggggccgacttgtcgtcgcccggacccgacagcgcccagtaaccgatggccagcgccaggaaggccccggccgagccgagcacgatcaggcggcggcgcctggccaccgcctcccgctcgtcgatcgtcggcaccgtcggcagcacccgggtctgccagtccggcgcggacgggcgcggctcatacatgtcggacacgcgcgacatcatgccagccgccgcccgcgctcaccagcggacgggcagcgtctccagaccgcggatcagcaggccgggccgccaccgcagcgcctcggccgggacggccagccgcaggccgggcagccggtcgagcagggcggtgaacgccacctgcgcctccagccgggccagcggcgcgcccaggcagtagtggatgccgtgcccgaaggccaggtgagcggggctctgcacgcggtccaggtgcagttcggccgccgccgggaaccgctcgccgtcccggttcgccgagagcaggccgacgatcaccgggtcgccggccgggatggtgaccccgccgatctccacgtccgccacggcgatccggaacgtggcggtctgcagggggccctcgaaccggaggaactcctcgatcgcggacggcagcagcgagcggtcggcccgcagccgctcccacccggcacggtcgcgcagcagcacgtacgtcccgttgccgatcaggttgacggtggtctcgtggccggcgatcagcagcaggaacaccatcgagcagagctcgtcctcggtgagccggtcgtccgcgtcgcggacctggatcagaccggagagcaggtcgtcgccgggggtgcggcggcgcaccgcgagcaggtcgcggatgtagccgaccatcgcctccagggccggcgccagccgcggcccggcctgcgaaccggcgaccaccgtgtccgaccactcgcggaactcgtcacggtcctcggccggcagcccgagcagctcgcagatcacctggatcggcagcgggaaggcgaacgcgtcgatcaggtcggcctcgtcccggccggacagcgcgtccagcagatcggcggtgatccgctcgatccgcgggcgcagcgcctcgatccggcgggcggtgaacgcggccgagaccaggcggcgcagccgggtgtggtcgggcgggtcgacggccagcatgtgctgcgagatcgcggcggcgacaccgggcgccatcgccccggcggcggccgctagctagctagcgccgcctgcccggccggcatcggggtggcccgcttggacagccgcggatcggccagcgcgcgtcgggcgtcctcgtagcgggtgatcagccagacggtcagaccggacggcatccgcacctgacggaccgggccgctcgtgcgccaccgctcgtacaccgggtgcgggtcggcctggaaaaccgcgtcgcccagatcggcgatctcctgcgtcatagcccgaccataggtcggatccaccccgatctccacccgtgggtggcagcgctccacccgccccgatccctaccttcagggcatggaaatcctcaccccgctcctggtcatcgccgctctcgcctacgccatggtccgccgttacctgggcgagccgctcaccgcgcgccgcctggtcgtactgccgctggcgctcaccgtctacggcggtttcatggtcgcccaggccggcctcacccacgtccgggccgacgtggtcgcgctggccgtcggcggcgtgctcgccgtcgccggcggtgcgctgcgcggcgccacggtgcgggtcatggtccgggacgggcacctgtggtaccgctacacgtgggtcaccctgaccgtctggatcggcctgatcgtgctgcgcctcgtccaggccacggtcgccggcaccctgggcgccgaccgtccggtgctggccgcctcgctggtgctcgccctcggcctgagcttcctcggcgaggccgcggtggtcgggccccgggcgatggcggtcggcgcgccgttcgcgccgcgccggtcccggcgccgggtcgccgccggccgctgacaccctgccgtcaccgcccattcggcacactgatcccgtgaacaccgccgatcgcacccggctgccggagctctggcgccgggcccgcaatctgctggtcctgatcgccgtcaccgtggtgatggtgcaggaccacgcgccctggccgctcgtggtcatcggcggcctgggctgggcgctgctgacgctgcgcgtcctgccaccccggccgcacctggtcgcggtctgcgtgacgctggcctccggactggcgctgaccgcgctcggcgcccgcggtgtcgccccggtctatctggtcgtcgcgctggccggcagcgccgccgtgctcgacctgatcaccaccggcgtgctggccggcatcgggctgctggccctggccgcgacgctggccacgcaccacgccgacctctcctcgatcgcggtctggtgcggggtgctgatcgcggtgaccctgctggtcctgctccgccgccagcgggaggcgagcgccgagcaggagcggttgctcgccgacgagcaggcgctggccgcgatgctggccgagcgggcccggctggcccgggagatccacgacgtgctggcccactcgctgtccgccctgtcggtgcagctggagacggccgcggcgctgctggagcgggaccggacgacggaggcggcggcgctgatcgaccgggccgggacgctggcccgcgacgggctgaccgagacccggcgggcggtcagcgcgctgcgcggcgatccgctgccggtgcccgaactggtcgccgagctgaccgcgggctatgcgcgggacctgggcgcgccggccaccttcacggtcggcggggagccgcgcgagctcgacccggagaccgggctggcgctgttccgggccgcgcaggaggcgctgagcaacgtccgcaagcacgcgccgggcagcgccgtcgacgcgcacctggcgttcgaggcgggcgccgtcgcgctgcgggtgcgcaaccacggcccggccggccccccggtcaccggactgtccagcggctacgggctgatcggcctgcgggagcgtgccgagatggccggcggcagcgtcacggtcgggccggacagcgacgggtggctggtggatgtcaggatgccggggtgagcatccgcgtggtggtggccgacgatcagaccgcggtccgcgaggggctctcgctgatgctgagcctgctcgacgacatcgaggtggtcggcgaggcggccgacggtgagcaggctctggagctcgtcggccgggagcggcccgacgtggcgctgatggacctgcggatgccgcgacgcgacggggtctcgacgaccgcgatgatccgcgagcagttcccggagacgcgggtggtggtactgaccacgttcgccgacgacgagcacatcctcggggcgctgcgggccggcgcggtgggctatctgaccaaggacgccggccgggtgcagatcgcccaggcggtgcgggccgcggcgatcgggcagggggtgctcgatccgcaggtgcagcagcgcctgctcgcggccgcgaccgggggcgccgcggcggccgggggcacggcggcacgggcggagcgggagctgccggacgggttgaccgcgcgcgaggcggaggtgctccggctgatcgccgccggactgtccaacaaggagatcgcgaagcggctgttcgtcaccgaggtgacggtgaagtcccatgtgaaccggctcttcgcgaaggcgggggtgcgggaccgggcgcaggccgtgcggtatgcgtatcagcacggcctgagcgcctgaggctgtcagccgccgtggcggcgggagaaacggggcgggcggaccgggaggcggcgccggcggaatgccgggcgcagcggacgccccgactcggagatcttactttcggtgaccgctacgatgcgagggtgcaacgggtctgcgctggccacggcgacggttcccctttcaggagcgatgcgggtgtccactatgcgtcgccgatagccgcccgtcccgccacttgaggttcttttaaagatcacctcagcgagggctaaccccgtccctcctggccccgtgcgcgtgacggtcagcggaagtccggccggcggacgaagctcggcgcgtcgttccgggtgatcaccggatacacgctcgagtgcacctgccaggacggctgcgggcggggcccggccagcgaccggatcagtgcctgcaccacgtcctgcaccgcccggtgcagcaacgggtcgtcgaccagcccccgctcgtcgacggcccggacgtccagcgggacccgcacgcagccggcccgcagcagccgcgcgccgccgtgctccagcaccgactccagaccggcccgggcgccctcgtcctgaccgggcgcgaccaccgacagccaggcggccggcttgccggtcaggtcgccgccgtcgaccagccagtcgaacaggttcttcaggctgccgggcagggcaccggcgtactccggggtgctgatcatcaccgcgtcggcggcggcgacctggcggcgcaggtccacgaccgacgccggcggcgccgggtcacccggcaggaaggcgggtagcgcggcgagtcccgaatagagtcgggcgtcgatctccgccggggcgaaccgggccgcggtgcgcagcgcggcggtgtgcacggaaccctcgcgagtgctacccgagatcagcaggacgcaggccatgcgccgacgatacggggtcagcgcccggcgtcccctcacagcgaactgtcagatcttcggcgcacagcgggtgcggcccgcccgatcgggtgccgtcgaggcttgggcatcgtgaggcgccgcccgtaccaccttccgttgatcctgctcgtgctcgtgaccacgtcctgctcggtgccccaccccgcgccgcgtccggccccgcggccgggcctgcccgccgcccagatccgggtcgaccaggccggctgggccaccggcgagtccaaggtggccacgctgctggcgccggccgacgcggccggcgcgcgggccaccgtggtcgacgccgccggccggaccgtgctgaccgtcgccgccgggcgcagccgaggtcactggaacgaccatttcgccgcgaccaacccgctggacctcaccgccctgcgcaccccgggcacctatcggatccgtctcgacgaccactaccacgcggagtcgccgccgttccggatcggcgcggccgccgacctgtacacgccgctggtggccgacacggtccgctacttccaggcccaccgggacggcgccgaccaggttcccggcccgtggcagcggacacccgcacacctcgacgaccggaacgccaccgtctacgccaccccggagcccgacgacagcgtgctcgcctcgaccggcgccacccttgacgtctccggtggctggtacgacgccggcgactacctgaaattcgcccacaccaccgcgtacgcgctgatcctcatgcagctcgtgcagcgcgacggcccggcgccggcggccctgcccgacgagatccggcacggcctggactggctgacccggatgtaccgcgacggcgtcctctacacccaggtcggggtggccggcaacgatcactacctgggtgaccacgacatctggcggctcccgcaggccgacgacgacctgtccgtgcaacccggcgaccgcgcgtactaccagcggtaccgcccggtgttccgggccgccgcaccgggcgagccgatcagccccaacctggccggccgggtgaccgccgccttcgcgctggccgcccagctgtcggccgccaacgacccggcccgcgccaggttctacctggatctggcggccacgctgttcggccaggccgccaccgcacccaccggcgacctggtcaccacggtgccgcgcgacttctacccggaggagagttacgaggacgacctggccctgggcgccaccgaactggccctggccggcaaggcgctgggcgatccgcggaccgccggctggaccgggcaggcccggcactgggccgacgcgaccggcggcggtgacgacggcctgaccgtgtacgacgtcgacgcgctcgccgacgccgagctgtaccgcctggccccggccgcgccactcgtcgccgacctgcgcgaccggctggccggggcggtcaaggcggccggccgggacccgatggacgccaccaccggggcgggcggcgccgactacgcggcccggcaactgggctgggccgcgaccgccgccctctaccagcgggcgaccggcgacacccgctacgcggcgttcggcaccgcgcagcgcgacgtcgcgctgggcgccaacggctggggagtgtccatggtgatcggtgccggcgcccggtatccacagtgtccgcacgatcagatcgggacgatcacccacgcggcgctgaccggggcggtggtcaacgggccgaacgtggccgggcgggtcgagtcgctggagagcgaggacgactcgatgtgcacggccgggtcgtattcggcgttcaaccgggacgacgcgcagtacgccgacgacatgcgggtgtcggcgaccaacgagccgtccctcgacttcaccgcgaccgggatgctggccttcgccctgaccgcccggccccgttgaactgatcacgctccgtaggcgtatccgaggataacgacgatcggagtgtgagccgcgatggtgctgtccgagcgcaccgcagggtacgacgacccgggcgaaccgggccggatgatcgagtacaccgccgcgatgtgcggcgagacactgaccggcgcggcccgacccggcgccggccccgacgacttctgcagccgggtggcggtgacctgcggcccggcccccgcaacggaagaagggccctcacgaggagggcccttcccggtgttgtgcgccgcgtaggacttgaacctacaacccgcggattaagagtccgctgctctgccaattgagctagcagcgcttgccaacgaggagaaacactagcacacccgaggagcaggacagctggacgggggtgactcccgggacgtgcgagaaacgacgaaggccgcgacctcaaatggtcgcggccttcgtgctggtgcgtcgcgtaggacttgaacctacaacccgcggattaagagtccgctgctctgccagttgagctagcgacgcctgccaacggagaaaaccgtagcacggcctcggaagatcctcgaaatcgaccgcttccccggcaacggcgacccgggatttgcctcgatgcgtcaggatggctgcgccgagaactccagaacggggaccgagatggtcgacctccgccgctgtgtggcgacactgctggcactgtccgtgaccgtgccgctggccgcgtgcggcaagggcgacaagcccgcgccggccgccgcggcgagcgtcgcgccgggggccgccgcgatcccggagagcgccaccacggcggccccggtcacgctgacggtcagcccggccgccgggcagaaggacctgccgaccagcaccgagatcgggctcaaggtgggcaacggcacggtcacctcggtccggctcaccgacgccgagggcggcacggtcgccggcgccctgcgccccgacggctcctcctgggtgccggccaggacgctgaagaacaggcaggcctacaccgccgaggtcaccgcgaccggcacggacggcaccaccaccacggcgaagaccagcttcaccacgatggcggccggcggccggcacaccggcaccgggctctacctgttcgacaagcagacgtacggcgtggccatgccggtcgtcgtcgaattcagccccggcatcaggaaggccgaccgggccgccgtgcagaaccggatgttcgtcgagaccaccccgtcccagccgggcacctggtcgtggacgtcgagcggcaccgcggcgtactaccgcgccccgcagtactggcagaccggcacccggctcaaggtccggatcgcggtcggcggtctgcccacgggcaagggcctccacggcgaccgggaccggtcggccacctcgacgatcgggcgcaagctcgagatgaaggtggagaacgccagcaagaagatgaccgtgctgcaggacggcaaggtggtccgcacgatgccggtgagcctcggcaagaagagcacgccgtcgtccagcgggcacatggtgatcatggacaagatggcgcagaccgtcttcgacaccaccgacaccgacccgaccggcggttaccgggtcaacatccagtacgcgcagcggctcacctggagcgggcagtacatccactccgccccgtggtcgacctacgcccaaggtcaccagaacgtgtcccacggatgtgtcaacgtgtcgccctcgaacgcccggtggctgttcgacaagacgctgatcggcgacccggtcacggtgcagggcaccggcgaccggctggactacggcaacggctggacaccgtgggacgtgagctgggagaagttcgccgcgggcagcgccctgccggtgcccgccgggctcggctgacggccgtcgccgggccgtccggtcagggttcggcggaacacaccgatagggatggcgtggccgtcacggcacgaatccgggattggtcaactggcgtttctggagcagtattgggcgccggggagattcgacgccgtgaggggaccagcgacatgacaccagttcggtcggcgggcagtggccgccgccagatgcgcgtgacactcgtcgcgctgctggcgggcagcctgctgttcaccgcggcatgcagcggcggcaagtcgccgagctggcagggcggcagcagcgggggcggcaccaccgagtccgggacggcgccgtcggcccagccgacgctgagcaccgtggcggtcacctcgccgcaatccgcggcgaccggcgtcgaggcctggtccgacgtcaagtacaccagcgaggacccggagaacaccacggtcaaggtgaccgacgccgacggctccgaggtcaagggcaccgtcgacaaggacgccaaggtgtggcacccggccgagtcgatggactggggcaagcagtacacggtgaccgtcagcaccccggccgcacagggcaagggcaaccagaccaccagcaacttcacgatcatgaagcagccggccaacctggtgcgggtcaccagcttcctcggcgaccaccagaccgtgggcgtcggcatgccgctgatcgtcaagttcggccgggccatcccgcagagctaccgcgccacggtcgagcgcaacatgaaggtcaccgccacccccgcacaggagggcacctggcgctggatcagccccaccgaggtgcacttccgtccgcagacgtactggaaggccaactcgaaggtcttctacaaggtcgcgctcaagggcgtcaagatgggcgacgggtggtacggccgctccgacatgacggtggacatcaacatcggccgctcgctgatcatgacggtctccaacaagaccaagaagatgacggtcacccaggacggcaaggtcatcaagaccctcccggtcagcctcggcaaggccgccaccccgtcgtccagcggcaccatggtggtgatcgagaagaaggagcacaccgtcttcgacaccaccgacaccgacccgaccgggggctacaagaccaacatcgacttcgctcagcggatcacctggagcggccagttcatccacgccgccccgtggtccgagggcgtccagggcaagcgcaacgtctcgcacggctgcgtcaacgtctccgaggcgatgggcgcgtggctcttcaagcagaccatgatgggcgacgtgatcacggtctccggcaccgaggagaagctgaagaacggcaacggctggaccgactggaacatgagctacgccgaatacaagaagggcagcgccctctcctgacgcacccgccccgcactcccccggctttcccgcgggcccggtctccacgaccgggcccgcggccttttccggccgaggcttcgcttccggtccgctggcccacggatccgcccgatggcggcgtacgccgtgaagcgacccgccgcgcgcggtccggcaccgcccgggcggcgtgtcacccccggtgatcgcgttccgcggacgccgtgtggcgacggtcgtaacgtcctgggcatgcacatccgcccgatccaccagggtgacgcgccccggctggcggtcctgctcgaacagctcggctatccgtcgaccgagaaggacgtccgccaccggctcggctactggctcgacgaccgggccagccacctgctcggcgccgacgacgacggcgtcctggccggggtcgcggccctgcacgtcaccccgatcatcgaggtgaccgggaagttcgcccgcctggtcgccatcgtggtggacgccgacagccggcatcgcggtgccgggcgcgccctgatggccgccgcggagcagcgcgcccgggcggccggctgcctgttcatggaggtgaccagcgaccgggagcggctgcccgcccaccgcttctacgagagcctcggctacaccgacacgcacgagagctcgcgccgcttcatccgccgcctcaccccggccgatccggcgcgttccaccaccctcgattgagcccgtggtgggcggctcagccccacaccgacccgccgccgcgaccgacgaccgccgtcgcgtcacaccgaccccgccaccacgacgagccggcaccaaccgcggccgagacccgtcttcgggtcacgcccgccacgaccccggccgatactcgtcgtcgcatcaccccgaccggtgcaacccgcaggcgacgctcaccgcgtcgtcgcgcccggcccacacaccggtgagcggtcagggccggcgcggggccagggtgtagctcagggagatgaccatgtcgatcagcaggatcagggtccaggggcccatcgcctgccagagcggcgcggcgcggtcgaagccgccggccagcggggtgaaggcggccagcagggcggcgctgatcgcataggccagaaggtgccgcagccactggcggcgttcccgggccgcgtgcgcccggccggtgcgcggcggcgggaccggcgcgggaccaccggcgaaccggtgcgcgaaccgggtgtcggcccagcgcaccatctcgtggccgaaaacgaccgtgatgccgaggtagatcgcggcgagtccgtgcgcgaagtcgggcaccccgccccgccgcaggtcgacggccgcggccccgagcagcacgacgtccagcaggggcgccccgagcagcagcgcggcgccggtccggcgacggcgcagcagataccggactgccagtccggcaagcaggaagatccagaatccgatctcgcaggtgacgatgagggcaaccatggcgacctctcctctttttcgcacggtcgtgttttctcgtttataacacgggcgtgcgatgatgagcgggtgccgaagatcgtcgaccatgacgcgcgccgccgggagctcgccggggcggtccagcgggtgatcgcccgcgacggtgtcgcccaggtgtcgatccggaccgtggccgccgagtcagggtggtcctccggcgccctccggcactatttcgccacccgcgacgagctgctggcgttcgcctgcgagcagatgatcgagcaggtcaccgagcggatcgtcgcgatgccgacggacgggccgaccccggcggtggtccgccggatcctgctggagaccatgccggtcgacgagcagcggtacaccgaggcggcgatcggcttcgcgttcctcgccctggggctgagcgacccggcactggcccgggtgcagcggctgaccttcaccaggatggccaacctgtgccggcagctgaccgacgcgctcaccccggacgcggacgaggcggcccggcggtcgctggcccggcggatgcacgtggtggtggacgggctcaccgtgcacgtgctggtcggacacctgacggcgccggagatgatcgccgaactggacacgttcctgagcgaggcggtcggcgtgaaccctcgtaccccgtaatttgggtctatgtcaggttttgcgggcctagtgttgttgatcctggtggccggggtcgccggatgctccgatcagcggcagcccggcgcgccgggctcgcccgccgccgcgagcccatcggtcgccgacgatccgccgggacggctcacctgtcagaatctggccgcggccgtccgatcggcgtccctgatggaccccggcgtggtggaccggatcgtggcggccagcggcagcgcggacgccccggtcgcggacgcggcgaccgcactgggcgaggcctaccggaacgcgcgggcctcgcacggcacaccgaacgagccggacgcgatcgccgcggtcagcgccgcggccgccgacatgtctcaggtctgcgcggacagcggactggactccgccgactgaggctgatcatccggctcggagccggccgctcggcccaccgatcctgcacccggctcggggccgggcgctccgccgacccatgccgctccgccgcttcgggccggtcgctcagccgcccgccgggaaacccccggtgacctccgccttccggtcccccgccgcgacgatccccccatacagatccgcgcccggctgccgcttcccggccgcgtgctgatactgcgccgcgaacacgtagctgcccgccgccagcgtcccgcccggcttcaggatgaaccggtagatcaccgccgccttctcctcggtgacgctcatcgtgatcatcgcggccgggatggtgctccagctaccggtactgatcaccccgtcggtgcgggccacgctgatcgccaggtccagcgcggtgatcaccttggtgctcgccaccgtcacgtcgctctgcgcccagtcgtccgtcgagtacacgtcgatcactccgcgggaggtgaggaacccgttcaccggctggaagctgggcggcgccgacgtcacctgaccgcggccggccggactcttcgccttcgcggccggcgaggacgtgccgggaaccgccggtgacggcgacggcgacgatgccggcgacgccgtcgtggtggtggtggtggcggccggcgcgcggtccggttcctcagcggtcagcagcttgatcccggtgaagccggcgaccagggtggcgaccaccgaggcggccgcggcgaccggacgcaggcccgcgaagcggcggaggaaagggcgcggcgcccggaccggctccggcgcgaaccggccccggtcgatccggtcgaacatcgcgtcgccgtccggcacgtgccggtcggcctcccggcgcaggatctccgccagatcagccatggtgacctccggtcgtcagcggcatctcccgcaggaactcgctcaactgggcggcgccccgcgaggtgtgactcttcacggcgccgagcgagatgccgaggatggcggcgacctccttctccggcacgtcgaacgcgtaccgcagaatgacgcactcgcgccgccgcagcggaagtcgccgcagggccgcgcgcacgtcgaggatcgcgggagtgtcggtttcgccgcggtcgcggcgcaacagaccgagccgcaacaggccggcgcggtcccgggtctgcttccggatccactgccgggccaggttggtgacgatgccgcgggcgtacgcgatcgggctgtccgccgcgcacacccgcgcccagtgccgccacacctcgacgaacgcgtcggacgccaggtcgtcggcgacctgcgtctcgccggtgacgagataggcgagacgcgacagatcggcgtggtgctcgtcgaagaaacgccggaaggcgccttcgtcgtccgtctccggcacgcggctcttcctgaccgtcgagggcccgcaggccgaccgggttagctgatcttcaccgagtacgcgctggtgtcgagccgccccgagccggtgaacacctcggttccggcctgcacgctggacagatacttggtcttgtcgagccatccccgccccgccaggtcagtggtgaaatcggtcaggctcaggtcggcggaggtggtgttcgaggtgcgcacgaacgagtacacgttccagccgatgttgcccttgtagaggtcccaggtggtgccgccgaccatcacggtcgcctgccgggtgccgatcgggccggccccgccgctgcggtacagccagaccatcacctcgtcggtcggctggtcctgccagtcggcgttgcccatcgcgtgcagccacaggtcgtacgacacgttcatgatgttcgaggtcttcggggtgaccgtgaaattccagctgctccggacggacctgccggcactgagccggaccggcaggccggtgccggtggtcttccagccccagtgccagccgaggacggcgccggcataggacttgaccttggtggtgtcgccggaccaggtccagtcggtgccccagctgaggttgtcaccggtacggccgttcacccagacgcactgggagccggcgccgtcggccctgccccaggtgttgttgttgacccagtacctgccgcggaccagggcggcgtagtcggtgcagttcttgaccgggggcgcggtcgctgtgggggtccttgtggtggtcactgtcggggtctttgcggcggtcgctgttgccgtctttgtagtggccgctgttgccgtctttgtagcggccggcgtcgtgccgcaggtcatcccgttgacgacgaacgcgtcggggatcgcgttcggcccacccagggttccgttgaagccgagcgacaccgtcgcccccgccgcgatgctcctgttccacccggcgtcggtcaccgtcacggtggcaccggtctgcgtccacgtcccggaccagccggaagccagcctctgcccggacgggaaagcgaacctgagcgtccacccgtcgatcgccgacccgccggtgttacggatctccacgtcgccggtgaaaccggaattccaccggctgccgacggtgtaggtgacggcgcacccggcggtcaccgcggcatcggcgttcaacacgccgacaaccgcggcgccggcaccgaccgccaccaccgcgagtggcacgacgaaacgcttgacgagcatcaggggggactcccgggggaagggactgggttgatcaccacctcagtggccccggaacccggaaaggttgcccactactcgaaagaatctcggaaacccgaaaaggcccggtccgaagaccgagcctttcgcatggggtgatcgacgggacttgaacccgcgaccccctggaccacaaccaaggtcactttcccctgacaactcctgatcagtgaagtctgcccagctcacggcaggcttcaggacccgccctaacggagcttgaccgcaccgcaggtagccatgccgctcccaacccggtcccactcgaccgcctcgcccagctcacgcctccgcagacgaaaggggacgatggcgcgccgttcgccggtgtcaggtcgaactggacgtaaatgctcaaatcttgggtcatgccctatgctgacaaactgtaagacttgattagatttctatatttacactgattgctatggccgtatcagccccggatgcgtctaccccgaggcgacgccggtcctctacctcagcggatctgccgctccgccctcgccgaagcacgcggcgttcgtccgcgccgcacaggactcccttcccggccatcccggccgccccgacgggacaccgctgacccggcagaaaaactcgacgatcgctgccgcccagcgcgccgcctcatgcgcggggttcgtcgcgaccggtcctggcgattcctgcgacgaatatccctatgccacgacacgccagggcggcgccacagccaaggtggcgcacgtacccaccgtcgataacaccaacgggggaactaagctcagtcgcttttaccgcgacatgcgtgtctgggacaacgacccgttcttcgtccaggtcgtagactgacccaccatgaccgacgaggacacgtcgcccaccctgcgtctggcgggcaatggggaagtctcggcgtcgaacggcttctacgagctactcgactacgaggggttcgatgacatcccgccggacgctaacgtcgacaacgggctcgtatccgtcgggtcgaccggggcgatcatcctcaccggaacaatggtcgggcctgtggcgctgcgtgtggaaattcaccacgcagcgccgcggctggacgttgccggatgggaacgggtcgtcgaggttgagcagtacaccgccagcggcatcgtgtcggtcaactccccgctcatcggtgatcccggcctgccctcgctggaaacgaccggaaacagttggtaccgcatccggattcacgcccgcggcatcgaagaagcccgggcctaccccgcgaccgtcgacagcccggtggaacaccaccttctccagctctggcccgctgttccagaaacgagcaccgaagaccacgagttccccaacccggcactacgcgaataccgagtgcttcaccctggataagatcgaccgtacctatatgcccaggggcagcatttcgccggaacagcacggccccgtccgggacctgcgacctcttctaccacaaccgaggtcattttcccctggccactaaagatccagcaggagatccgttttgggctccataagggcttgccggccgtagtggctggtcttggcggtggcttgatggcgtcgtaggtaggtggatcagacgatggcgtcggcgacgcggcgtgcggggctgatgatcagggcgtggaacagacggcggagttcgtgaccgtgaccgcgatcaggccgtccggagtttcgctgctgacagtggtcgctgcggcgaggaacgcgtgggcggcgatgtccaagctggtccagcggcggtgttgatgctggtccgggccgaggccagtcttcgtggcctggaacgatcgctgcttctcggcgcagccgccaactgtgggtcaccgccataggcttcgtcgccagcgacccaccggcacgacagcccgctggtcaccgcggtctcgatcagccggcgtgccagctgcggtttcgtggcgaacgtgacagtgtcgtgtactcctgcttcggcccgtcgctgcggatcgtcggtccaggatcttggcaggaagagcgcgacgtcgaccagggtgtgcccgagcggtgaggcttaggataggtgcactgcgagctggcaattctcgatcctcccagcggtgcccgagtactgccgctgcacaccgacggtctgagtgcctttcttcaggtcaccggtctcatcgactagcagcacgccgtcgagatgcccgagccgggcggtcacgaaagtcccgcacgtccgcacggaccagtgcgtcgtcccagctggcacgaccgatgaggtcctgcatgccacccgggccgtcgtcgctggcgtgttcagcgatcgtccagcagttcttgaccggcaacggcgcgagcaggggggccggggcaggctcaaggacggctccatgcgcaccgtggccactcccccgttcctgaacggcctgttacagcgtcatctggcctcgggtgtcccgctcaagtgcccttgcgttccacgggtcgaagatgactcccggattccgtggtgcacgggcggcgagtatgcgttcgcgactgccgaaagcgcgcactaccgtcgttcgaacgtcagcgagcggattttccggccggccgccgatggctggtatccgcagcgcgctccccgccggccccgcatgccccgcatgccggttctggttgaccatcagttcccgtggccaggcaagccgctgccggcatggccggccgttgccccgggcgagccatacgagctctcgcagggtcggggtcgcccgcgcgtgaccgacgagtcgcggctggcgtcctggttgccggtcctgtgcgacctcaccccgcacggcatgcggcacggctatcagacgtggatggacgaggacgagatcccgtacgtggctcagtcccagcagatggggcatgaggtgccgggcatgcacgggatctacagccacgtcacggatcggatgctggagcggatccgcgccgcgcttcaactgcggtgggaggagtcactcagagcccgcgcggcgctgccgctcacctcggccgttccgttgcttgccgcagccctgaagacgctccctcgagaggcgtccgctcccaatccgctcccaaattcggacgcctaacagggagaggccctgaccgctttcgcgatcagggcctctgacctgcacttcacatggggtgatcgacgggacttgaacccgcgaccccctggaccacaaccaggtgctctaccaactgagctacgaccaccatgcccgcacgggaaagctgttcccgtgttgccggctaatcatagccgcccgccccgggccgccgtcgagcgggttaccgcgtggcgcgttcagaggtcggcggcgaccgccttggcggtctccacgtccgggccgggcggcgggacgaagacggtgcggcggtaatactccagctcgcggatgctctcccggatgtcggcgagcgcgcggtgcgacaggcccttggccggctgaccgaaatacacccgcgggaaccagcggcggcacaactccttgatcgaggagacgtcgatcatccggtagtgcaggtgggcgtcgagcgcgggcatgtcccgggccaggaagccacggtcggtggcgatcgaattgccgcacagcggggcggtgcggggattcggcacatgctccttgacgtacgccaggatctgctcctcggcctccgccatggtcagcaccgagcggcgcacctcctcggtcagccccgacttggcgtgcatgtcgcgcaccaccggcggcatcgcgtcgagcgccgcgtcgtcggcgtggatgaccaggtcgacaccgtcgccgagcacattgagatcgggatcggtgaccagcgccgcgacctcgatcaacttgtccttgccgaggtcgagaccggtcatctcacagtcgatccacaccagaagatccgccacccggacagcgtacgccgcaacccacgcggttgttcgacgcgagtgtcacctcagcgaacattcgcgttgtatgtccgctttagtgggtccccttaccggttgggcggttgagggggtaaagtgtgattaacggacgaagccccccttcggttactccgttccccccggtaaaaggggccctccacgtcggcagcgcggagggccccttttcggcttcccggcaaccccaccgcccgcaccgaagccgcgagggccatcgatcgatggccctcgcggtcacttccgattgcggcggtacgccgtgatcacccctgttccggcgtccccttgccccggttgcgcgccgagccgcggccgcccgccgcccggcgccgcttcggctccccggtcccggccagcagctccgccgcctcctcccgataattcggcatccgcggcgccggcttcgccacttccacagcgccggtgtccgcagcgccgccggcctccccggcgcccgcagccttagcgtcaccgtcggcctgcccggcgccgccaacctgccccgcgccgctgacctgccgcgcaccgacagcctgctcggcaccgcgggcctcttccccggtgcggccagactgcgggacgccatccgtcctgcccgcggcgccccgtgcggcaggctggccgctgtccgacgtgccagcggactgcctgacgacggccggcttctcggccgccggccgggcggtccggggccgaggcttccgcgccaccggcgacacctcggcggcctgggccacggccggcgccaccgagccggccccggacccgacggaggcagtcccagccgcggacggctcacccgatgccgccggggtttccgtggatccggcagattccggggcggcgggctcgtcggccgacgtctgcgaggccgcgcgggcggccaccgtctccgccgccttgagccaggcggccggcaccttccgggcgacggcggacccggactgccggccggcagctccgctcaaacgatcctgggcgcgggacagcgggtggtccggctcggcggtccgcttcggctcggcccgcttcaccgccggcttacccgccttctccagcgcatccgcccgcggtcccgcctcgccacccggccggtccgactccgcggcgctccccggaacctccgacgcctcgccatcgatcccggcctcagcggcatggagggagggccgctccgccgcggaggacggcaccccctccgacccgccggccttcaccgtctgggatgcgctggagaccgggttcgcccccgcggagtcaccggcctcagccttcgccacggccgcggagccgccggcctcgaccagctccccggcctgggagctgtcggtcccgaccacattcacggccgcggagccgccggcctcaaccagctccacggtctgtgagctgtcggtctcgaccagctccacggccgcggagccgccggcctcgaccagtttctcggtctcggggcgggcgggctcggccggaacagcttccgtgtcggggaccggagcggcctccgcctcgtggatcgacagccggcgctcaccgacccgagcggacggcaccggccgggcgggagtgctcgggtgccgagtcgggaacggcacgatcggcgtcttcggttcgtcccgcttctcggtctccggagccggctcgcccgaggcgttccgctgctcagtcccggacaccacgccctcgattgccggggcatccccggtcaccgccgcggtggcctcgacggcagtctctccgtcgaccgccgcggtgtccaccgattccggctcgtcctcgacgacagctcccgcagcagatgcgggcgagaccgccgtccctgaagccgacacctcagtcgcggccgtgtcaccggctgccgggtcagtggtcggcgtctggttcgcggccgggccggcgtcagccggagaagtgacggcagtcgcggtagcggcctcgtcgggggcggccgtgccggtggtgacggcctccttcgcggtgggctccgtggccggagcttgagccggcaccgccttcggggcggttcctgtaagggcggccctgctgtccccggcatccgcgatctcggtgtccttggtgtccaaggcgtccttggtgtccaaggcgtccttggtgtccaaggcgtccttggtgtccaaggcgtccttggtgtccaaggcgtccttggtgtccaaggcgtccttggtgtccaaggcgtccttgggggccgcgaccttgaccgctccggacgcaacggcgatcttggcagcgcccatcgcggctcgcgacggcatggcctgcggcttcgccgcggcgacggcggtgtcggcggtgtcaaacgtgtcagcggcgtcggcggcagcgtcaacggtgtcagtggaccgagcggcgctggactgccgaccaggttcgaacccggcgtgggagggtgatcccgcggtcgacgggtgagcggcggacttgggcgagggacggctgctgcccatccgggtcagtccggtcgccgaccagtcggtagcactcggcccggtgagcagcgcaacccgccggggagccggagccggccaggccccgcggccgtgcccgggcttcccttctccgcgccgcgtggcctcggccgactccacctcgccggactgcacgtcagccggctcaacgctggtcgacgtgccatcaaccgtcgcaccctcaggctgcgagacctcaaccgtcgcaccctcaggctgcgagacctcggtcgtcgcggcttgggtcttcgcaccctcgatcggcgcgacgtccgcattcatgccatcggtcgatgcaagcccgccggtcatggccgcgccctgcacgaccgcggccgacgtagcgccgccggtcacggcttcgggcttcccggcctcgaccgacgtcgcctcgaccggctgagcaggaacagcttcggcaggttccgcgtcggatggtgcggcccggaacgcggtgtccgcctgcttcgccggtgtgaccccggtggcgggcgccgcgcggtggcgggctgcctcgcggagggccgcggcggcctgggcctcggtctggcgggcgcgttccggggcagtctgggccacccaggcaccgaccgcggtggcgtggaattccggcaggtcggccgcggccgcgttccggcggcgactctgccggtcggggcgggtgcccggcagggcggcgggcaggccggccggtgccggtgtctcgccgagaaggcccagcggccggccgggtgtgagcgccggtgccgcggcaccggcgaggcccgtcgcgttcgggccggcggccggagcttccgcccgctgccggttgcccggtgcaccgccgggggccttcaccggtccggatgcggattccgcgtcctgaccggtcatggacacaggggccgccgcggattccgcgccccggcccgccgcgaacacagcggccgccgcggattgcgcgctccggcccgccccgaacacagcggccccggcgacgtccacggaggccgggtcggccatcgaaccccagggggccgccgatccgtccatcacggccggacccgaagccgccgagtcggcgatcggctcggaacccggggccgccgacgatccggaggggaccgcccggcccgcggccggcgctgaacccgccgaagcggactcggtcgcggaagccggggacgggacgggcagagcgccggggaccacgggggtcagggcgttggggcggatgctggtcgcggtgtgcgaggcggaggcggctgatgacgtaccgcgcaatccggaggtgaccgggaggtgctcgccttccgtgccgccggccttcttcggcggccaggcgaactggggcagcgccggcggccgggccggctgcgagtcggccagggtgcgcgggcggtgcgccccgtccggccccccgaagacgccggtgagggtgtcgctgtcgcggtggctgccggggagacgctggccgaaggcgcgctgcagcaggccggcgtggccggcgtcgtcgccgtgaccgaatccgaccaggccacgccgcatcagcgcgagcgcaccggccgggttcaggccatcggtggtgccgccttccagggcacgcatcggcagcggcgcaccgatcgccttcatcaggtcggggacctggctgggttcgacgacgtagacgatgtcgcgacggcggccgggggtggccaggaccacgacaccggccatcaggaggatggcgccgagggtgagcagggcccaggcggccgggtcgagccagccggggcgggcttcgacggtgccgtcgaggcgcaggccgcgggcgccggtcgcgttcatgatcaccaggctgtagtcgccggaggccgtctccggggtccagcgcagcgcgccaccgccggtgctggtccagaagctctggtgaccgggggcggacggcagcccggtcgagccgtcgacccgggtggcggtgatcggcagttcgccggtgccgacctggacgccgctcacctcggtgtgcggaacgtcacgcaggtagtcgtcgacatcggcggccggcgccaggccgatgaaggcgggaccgccggcggtgagcgcggtgacccgcaattcggtgccgccgatccgggcgaacgacgcgtcgtcgcgcagtagccggtcgacgtccggtaccacgatcgcgtacccgggcgcgtcgagtcgctgcagctcagcactgaaagcgccgccggcgtcgcggtgccggaggacggcccacaggcatccgccggccagcagcgcgggcagtccgatcgtcaaaagcagcatgccgaggaccggccggatcagccgcatcgttcattcccccttctcgggccccactgcgcgcaccataccgaggcaaatatccccaaagtggtcaaacgagcaggcagccctcaacagatacggcaaaggcccggtccgttacagaccgggcctttgtcgcacaagggaatcagcggattttcaccgtcgcggtgaaggtggtctgatcgatgtcggacgtgcgcgcggtgaacttgaacgtccagtcgccggcctgcggcagcgcgaagtcgccgatcgcgtggaagtcggtgatccgcagcaggggaacctcgatcggttcgatgcccgcggacggcagcgccgcggtcgccttccactccagcaccgtctgcggtttgttgtccggggtgtacgcatacacgtgcatcgagttgttgcccacggtcgccggatagatgtccatctgcagcgtcatggtcttctcggtcagcgtctgggaaaccgtggtgtcggtggtggtgttctccgacgcctcggcggtgcgtggcggcgcgatctgcaccagcgccgaggtgaccccgagcaccacggcggtgaccgcgagctcggccagcaccatccggcgcaggacgcgcggggactcctcggcggtccggtccctgaccagtttccgggagtacgccgcgatgcccaccaccagcgcggcgagacccgccttgaccaggatgagccggccgtacgtgctggtgaacagcccgctgagggtggagatctcgatcagcgcctggaccacgccggcgaagatcagcgcgccgaccgcggtgaacgcccagcgcgaccagatcggcaggatcgcggtcagctcccgtgcgttggcccggggcagcaggaacgcgaacagcatgaccagcccgccgagccacaccgacatggcggccaggtgcagcgcgtccagcaccaccgagacgcccgccaccggggacgcggtcgggtgcccggtcagcggccaggtggccagcgcggccacccccaggacaccgagcagcgccaggtcgagccgggactcgccgcccgcgccgaccaacagcgggcgcagcaggaacgcggcggccaccacgaccgccagccggaccagcatcaccgcgccgaacgtgctgcccagcacgtcgcgcaggtcgccgacccggacgtcgaagaggctggtgcccagcgtgtacggcgcctgcagccagatggccagcacggtgctgccggtgaccaggccgatgccggtccagatcagccggccggggccgcggcgggacagccgctgcggccacagcagggccagcacgagcaccggcccgaccaggagcacgagtccggcgtaccccagatatttcccgaccgggatgagggtccggaccaccggatcgaccttgacgttcgcggagtcgtccgccgagggcggcgtcgacggcgcgcccaccgaatagctgaacgtgccgccgaccgggtgcgagtcggcggagatcacccggaaggtgacgaggtaggtcccgcgggcgccgccggagcgcaacgggatggtcacccgggagccgtcgaccgccggatcgccctggtcggcgcgggagccgtcgggcgcgaccacccggatcttgccggagatcagctgcaccgactcgctgaaggtgagggtcaccttgttcggcgcgtccggcacgatcgtgccggtgcccgggtcgctgctgaccagagccgcgtgcgcgctggccggcccggccgagagaaggaccccgatcagcccgatcaggagtccgagcagaacggtcgcgccccggcgtcggtcaacggtcatgacggccatgctctctgatcgcctccgggaagaccacacgcgggtggtacgtgcgcaacacgcggccggttcgggtcccggacgatgcgcgtacgatgcggctcgtgaccgatggtgagcacgagacggacgagaccaccgcgctggcgctggccgcccgcgccggcgacccggtcgcccaggccgcgttcgtgcgggccacccagaccgaggtgtggcgattcaccgccgcgctggtcgacccgggcgccgcggacgacctcacccaggagacgttcctgcgggcgttccgggcgctggactcgttccagggccggtccacggtgcgcacctggctgctcggcatcgcccggcgtgcctgcgccgaccacctgcgggccgtggtgcgccgccgccggctggatgtgcggctcgccgcgcaggccgcgaccgaggcgccggcgcccgacccggcgcaccggatgaccagcgcggacctgctgagcaggctgagcgacgagcggcggacggcgttcgtgctgacccaggtgatcggcctgtcctacgcggaggcggccgaggtggagggggtgccggtgggcaccatccgctcccgggtggcccgcgcccgcgacgaattgatcaccgcggtcgcccgggcgcaggcgagctgactgagagtttccttgggaccggagatggtcgggaaccagggccggatcatcgtcgtctaacgggcgtgaccatggaaaccaccacgcgcgcatcggcctggccgtgggtctccacgctggcccggctcgggctggccgccgtctggctgatcgccggcgccacgaagatcggtgacctggccgagtcggcgcgggcggtctacgcgtaccacctgatgtcctatgacgtggccaaggtcgtcggcggcgtgcagccgttcctcgagatcgcgctgggcctgctgctgctggccggcctgtcgacccggctggtcgccgggatctccgcggtgctgctggccgtcttcatcttcgggatcgcctgggcctgggcgaaaggcctgcgcatcgactgcggctgcttcagcaccggcggcgatctggccgccggccgcgccaccgagtacggcttggacatcctgcgtgacctcggtttcctggcactctccgggatcctgctgtggcggccacggacccggttctcaatcgatggcgtgctgatgggggatgcgtcgtgagcaagggcagccgggaccgcgcggtgaaggcgcggcagatcgtcgagcgacagcgggcgcaggagaaacgccgcaaggtgaccctgtggacctcggtggccgtggtcgcggtgctggtcatcgccggcttcatcgggtattcgcagctgtccggcacggatgacggcaagctggtcaccccgagtgtggcggtcgacgagggcaccgcgttcgcggtcggctccggcccggtcaccgtcgacctctacgaggacttcatgtgccccaactgcaagaacttcgaggggtccagcggcgccacgctgcggcagatggccaccgccaacaagatcaccctgcggtatcacgtcgtctcgatcctggaccgctcgtcgaacgggacgcggtattcgacccgggcggccggcgccggcgcggcggcggccgaggacggcaggttccccgagttccacgacgtgctctacgccaaccagccgcaggagggcagcgacggcctgtccaacgcgaagctgatcgagctgggcaagtcggtcggcttgacgagcgacaagttcgcgaacgcggtcaacgccggtacctatgaggcatgggcgacgcagaacaccgagacgttctccaagcgtggcttcaacggcacgccgaccgtcgtggtcaacggcacccagctcaagggtccgaacgacaccgtgccgcagctcgaccagatcacccaggccgtcacgaaggcggccgggtgagacggatcaccctgatcctggccgtggccggcgcgatgatcgcgccggccacgcccgcgttcgcgcacggcggcgagggggcgaacgtgacctcctaccgcaccacggtcagcgggatcagcgacccgatgcgcggcctgtcggtacgcaccgtcgagggcggggcccggctggaactgaccaacgacaccggccggtcgatcgaggtgctcggctactccggcgagccgtacctggagctgcgccccgacggcgtctaccagaacctgggctcccccgccgcctatgtgaaccggaccctggccggcgacaccccggtccccccggtcgccgaccccaccgcaccgcccagctggcagaaagtgtccgccggccacacgatccgctggcacgaccagcgcacccactggctcggcacggtccgcccgccgcaggcggtgaccgaccccggccatgcgcaccggctgcgtgactggacggtcccgctgcgcgaccaggtccgcctcttcgcgatccgcggcgcgctggactacgagccgccgccggccacctgggcgtggtgggccggcgtgctcctgctcaccgcggccctgacggccctgatccgcttgcgcccacgggtgatcccgccactcgcggtcgtctccgctctttccatcctcgcgtacgccgtgacccgcggcctggacggcgccggttggtccggcgtcctgctcctgaccgccgccctggccctcggcgccgcctggaaacacccgccgttctacctggccctgtccggtttcgtgatcgccgccttcgccggtttcgccagctccgacgtctatctggccgcggtcgtcccggccaccggccccggctggctcgcccgcgcctgcgtcaccgccaccctgaccaccggcgccaccctcgccctcaccggcctcctccagatgcgcgccgccgtccccgaccctgcccccgcgactagggtgtcgtaaggcgacagccgggccggccaggggaggacattcggtgtatctgcaccgcctacggatcagcgacgtgcgcggcttccatggttcccacgaggtcgacctcggcttcgagctttccgcggacggcgagccgaccgaccgctatcccggcttggtcgtcatcgcggggcgtaacgggtcgggcaagacgacactgctccgggccgccgccaccgccctcgccgggccggaggtcaccaacagtttgaccgaaggcgtccgcgactgggtgacccacgaggcggcgacggccgtcgtgcacgctgacattcggctggccggagatgagatcttcccgccggaacgcttcctcgaggcacgcctgcggtggccgcggacggaaggcgcgcgcgccagaccggaatcggggcttgattcccggagcgagcagcacgcgagaatttcgctgtggcggtccaacccggagagctggttcgcggccggctacggaccattccggcgcctggccggttccagcagcgaggtcgcacgcctgacggccggcgattggaccgtcgcccggttcgcgaccctgttccgggaggaggcctcgctcgccgagaccgtccactggttgcagcaggtcaactaccgtgcccggtccggtcagcagcggtacgccgacatggagggcttcctcctcgccctgttgaacgacgggctctttccggatggacatgccgtcgaccgcgtcgacccggatggactctggatcgcccggcagtccggcccacccatgttgatcgaggagatgagcgacggctaccgcagtgtcaccgcgctgatcaccgacatcgtccggcagatcagtgactgcttccggctgggcgttccgtggaccggggaatacccgcccagggtgctgacgtcggggatcgtgctgatcgatgaggtcgatgcgcacctgcacgtttcctggcagaaacggatcgcgccatggctgcgggagcacttcccgaacatccagttcatcgtgaccacgcacagcccatacatctgccagagcgcctcccccggcggtctcatccaacttcccggcccggacgacgatttcgcaccccgcgtcgtcgatgacgagctctaccgccgagtcgtcaacggcagcgccgacgacgccgtgctgaccgagctgttcggcctggaatcgccatactcccagcgggtcgacgaactccgtgccgagctgacccggctggaacgactggccatccgcggccacgcccaagccggcgacctggagaaactcgccgagctgagcgaggagttgtcgccgtcgccgagcagcagggcccgcgacgtcctcggcggggaagcgtgatcccgttcgcccgccggcccctcccgggctccctctccaccagtctcgccgccagaaccaggcagctcagcggtagcaccagcccgtaccaggacgcgcggaaagcgtggaagaccgccaccaccacgcgtcgtggcctgaagacacacctgtgtgtcagttgcgcccgaccggctttctgcatgtactgccacgagagccggggcaccgacgtcgaccactacgagccgatcaggcgggctccgctgcgaaccttcgtgtgggacaaccatctgctcgcctgcgcgtactgcaatcagcaggctaagcaggaggtgttccccctcgacgggaacggacagccgcttctgctggatccgtccgtcgacgactcggccgatcacatgacattgctttcgaccggggtcttcgaagggctgaccacgcgcggggctgaaacgatcgaggtgctgggcttgaacaagcggcccgagcttgtccgggcgcggaccgtgtcctggcgcggtgtggtgcgggtgttcgatcaggccgctctgcacggaggcgtgctgaccccgaacgacctggaggacctgcggttcctgccggtagtggacgctttccaccacttcgcgcatgacgttgtggcggggcggctcgggttcaaaggcgtacggccccatgtggtgacttctgctgacgcgaacctggcggtgatccgcggcctctttcccgcatgtcgcctttagacgagggccgggtcaccggacgggagcgcgaagctgcccgttccggtgcggcggacgcggtgggtcaggcctgaagggcgatgtcgtcgacgttgacgttgacggccagcacgcgcaggccgtagctctgcaccgcctcggtgaccttctgctggacggcggtgacgacctcggcgacgaccgtgccggcggccaggacgacgaccacgttgatggtggcggtgccctccttgacgtcggcgcggacgccgcggctcgcgtcgccgacggtgtccaggccgaccctgtcgaggacgctgttgaagaagcgggcgacgtcgccacccaggtcggcgacgccggggacggtgcgggcggcggcggccgcgatcttctccaccacctcgccggagacggtggtgttgccgttcgccgtggtgccgccggtgggttcggtcatggcctgtgtactccgctctcgacacggaagcgcgactcgcgactccgccggggagcgtactgaagatccgtggcggctggccagaccggcattcccatgtccgcgggagcacatcggaaagcgcactgtccaccgtgtcttcaccagggaaagccgtgcgggcacggcctgccgaaacggaatcctcatgcggcctctaccagcggaaacgtggcatatcgcggggttcgcggggcgactactgtgaagtcaacggccctgggaggcgtcatggacaacgatcactacggcgatgagctgaccctccggttgtccggcatcgccgacatcagcgcgctcgacgacgacgaggtcttgacccggttcatgcgcgacctcgtcacccggatcgggatgacggtgatcgccgggccgctggtggccaccgagggcgggccgccggagaaagccgggaaatcagccgtggtgatcctggccgagtcgcacgcggcgatccacacctatccgcacctgcgggagatcttcgtcaacgtcttctcgtgcaagccgtttcgggagacggacgtgctggccgcattccaccggctggtcggcgactactcggtcaccgagtacacgctgcgccgccgcggtgagcagtggccccgggacctgaccgccgcggaacgcctgtggagtgcccgccgcgctgcctgaccgggcacgcggtgccaccggaagccgggcgggcggcactaatctcggtgccatgactgacaacgtgcgtctcagcgccggcgacgccgcgcccgacttcaccctgaccaccgacaccggcgaaagcctctcgctgaaagacctgcgcgggcgcaaggtcgtgctctacgcctacccggccgcgatgacgcccggctgcaccaagcaggcctgcgacttccgggactcgctggcgtcgctgcaggccgccggatacgaggtggtcgggatctctccggacaaaccggccaaactggcgaagttccgcgaccaggacgcgatcaccttcccgctggtcagcgacgaggacaagagcgtgctgaccgcgtacggggccttcggcgagaagcagttgtacggcaagacggtgaccggcgtgatccgctccaccttcgtgatcgacgagaacggggcgatagagcgggccctctacaacgtgaaggccaccgggcacgtcgccaagctccgccgcgacctcggcctggactgagactgtccgaacttcgggaaagtccgcaagtcggggcccggaacgccgatgaggagggcactccacacggctccgtcaccaccggtgcggaccgggtccccggctcacggcggtcgtcatgcggtaccaacccgcaaggcggccgccgtgcacggcgatgggaaacggtcagaaccgaggagccacggtacggcctgaccgtttagactccacccaacgctctgccccgtgacgggcagaacgagcgggagtggcgaaatcggcagccgcgcgggttttaggtgcccgtgcccgagagggcgtgagggttcgagtcccttctcccgcacgagcggagggcggagtgtgtccgcggaaagcgcggacctggcccgctcgtcatgccggctccgggggccgagcccccggaagccccgcgtcacgatgggcgcggtgggcggatcgcgcgcggtggggggtcgtcactcaccgaacccgacgccgacagggcgcgtcatccacaggatgcgttatccacaggttgtgcacaggggttttcgggttggccgtgcccaacagcggatggtgacccgcttcagcttgcgcggatgtcagccgcagctggttgtggcgtcggcggcggcgaggagtgcgtcctcggtggtgcccgggacggcaacagccgaagcgggcagcggggccaccgaggacgcggacggggtagcggccttgggggcgaccgaccccgacggggacacagcaggcttggcggaggcgttcttcttggcgacggtcccgttctcgacgatcgcggagcggccgctgaccgacacgccggtcttctgcaccacgccgggtttcatcgcgatgccggacaccgtggtcgtgatgccgtagacgtcggtgatcttcaaccggtacggcccggagccggccccgccgtcgatcagccagtagttgtagtcggtgcgctgcgcgctccggaacgtgccgccggggcccgccaccttgaccgacgacagcaggttcgcgtggttgtcgatgcgggcggcgaaccagtaccgggacgcgccctccttgatccggaccgtgatcggtccggggacccgcgggttggcgaccagcttgtacttgatcgggatgatcccggcgacctcggcaccgatcttcttgaacgcggtatggctcaggtccaggtgtccggtgtcgcactcggggcaggagtcgaagaccttgacccggacggtgcccttcgggccggtgacgtcgaggtacgccccgcaggacgcgccgccggagtactcgtcggggccgagcgcgacgtacaggtcgtcggccgggacctcgaacgagcagttgccggacgtgccacccaggtcgtagaaggtggctttgccggtcttggtggtggtgctcggcggcgcggcgcaggccgatccgccggactgcagcaccagtgccacgccgatgatgccggcgaggccggcggcgccgccggccgcgagccatcgggtcgggaacgggcgtcgatgagcactcacgctcagcgatactggttgcggatggcgctcgcggcaaatgttctaagactctcctaagacatatgtaccgctaatgagtgccgcgtcactccagcggtgtcaccgcgtcaccgggacgtaccactccgctccggccggccgcgaggtccgggatcagtttgaccccgaacatcaggccgccatcgatccgccggtgccggccgagcacgtgcagcggctgccggccggtctcaccggtctcctggtcgatggtgacgaccaggcaacgggcacagtgcttggccacccggaaggtgacctcgccgatccgcagccggccacccagccagccgtcctcggcccaggcgggagcaccggtgaccaccagattggggcggaaccggtgcatcgggaccggatcctcgccggcctcggccagccagtcgttgaccgcgtccagcgacgccgtgctggccagcagcagcgggtagctgtcggcgaaactgacccggtcgctcggcagggcgcggtccgcgatggtgcgaccggtcgggtcggcctgccaggtcagccgggcgtcgcggccgaggaaggcgctgctccactgactctcggcaacccgggcgggcacctccggcttgttccggaacacccggacactgatcttggcgccggcggccggctcatcgatctccaggtcaggcaggcccggggcactcaggcgcaggccgccgggcctcgggtggacggcgagctgggtgagccgcggctcgtcgcgttgcgtcaggcccaccccgtcggggtcgaccatcatccaccggcggtcgcccgccaggccccagggctgaacttcggcctcggcgtggtccaggcgatgacagcctttgaccggatacgtgtgcaggtccctgatccgcatgcccccagcctttcatggctgcgcccgaccgagggcctggcgtgtgaaagtttttatgcataggctggcctggtgaatgacggagtggtcaggacggcggagcgggtgctcgacctgtttcagggggcgcgcctgaccccgacccagcggcggatcgcgcacagcctggtcgagcacgcggccaaggcggcctatctgtcggcggccgaggtggccgagatcgccggggtgagtcagccgtcggtgacccggttcgcgatggcgctgggctactccggatatccggcgctgcgccgcgagctgcgggcgctcgcctcggacgcgccgagcgagccgggcggggagaacgcgatgcagcgggcggtgctggccgagaccgagcatctgcgccggctcgccgaggagctgcagcggcccggcgatgtgcggcgggcggccgagctgctggccgccagccggccgctgccggtgctgggattgcgcgcggcggctccgctcgccgcgtatttcgggtatttcgccgccaaggccttccccgatgtgcgggtgctcgacagcggcgggaccgggttgtacgaccggctggatcaggcccgcgcggcgggcgccggtgcgatgctggcgatcgtgctgccgcgttacccgcgcgagtcggtcgaggcggtccacgaggcgaaggccgccggcttcgccgtggtcgcgatcaccgactcggcggtcagcccggtgtccgaggcggccgacgtggtgctgcccgccgcggtcggcacccagctcgtgttcgacctgcacaccgggccgatggcgatggcgatggtgctgctcgaggcgatgtgcgacgccgctccggagccggtgcaacgccggcttgaggagttcgaggcgtcggccacccgccggaacatctttgtggcgtagggaacaggggagatgaccaggatggacgagatccgggcaccgcgtggcacgtcgtacaccgcaatgggctggccgcaggaggccgccaagcggatgctgctcaacaacctcgacccggaggtagccgagcggccggaagatcttgtggtgtacgggggaaccggccgcgccgcgcgcaactggccgtcgttccacgcgatcgtccgcgagctggacacgctcaagggcgacgagacgctgctggtgcagtccggcaaaccggtcggggtgctgcgcacgcacgagtgggcgccgcgggtgctgatcgccaactcgaacctggtcggcgactgggccacgtggccggagttccgccggctggagcagctcgggctgaccatgtacgggcagatgacggccggctcgtggatctacatcgggacgcagggcatcctgcagggcacgtacgagacgttcgccgccgtggccgccaaacgcttcggcggcgacctgggcggcacgctcacgctgaccggcgggtgcggcgggatgggcggcgcccagccgctcgcggtgaccatgaacggcggcgtctgcctgatcgtggacgtggaccggacccggctgcagcgtcgcgtcgaccaccggtacctggacgtgatcgccgactccctggacgacgcgatcaaccgggcgctggacgccaagtcccggaaggccgccgtctcgatcggcatcgtcggcaacgccgccgaggtcttccccgagctgctgcgccgcggcgtcgcgatcgacatcgtgaccgaccagaccagcgcgcacgacccgctgagctacgtgccgatcggcgtcgacgtggcggacgccctggactacgcgcggaccaagccggaggagttcaccgagcggtcccgggccagcatggcgcagcacgtccaagccatggtcggtttccaggacgcgggcgccgaggtgttcgactacggcaactccatccgcggggaggcccagctgcacggatacggccgggcgttcgacttcccggggttcgtgccggcgtacatccggccgctgttcgccgagggcaagggcccgttccgctgggcggcactctccggcgatccggccgacatcgcggccaccgaccgggccgtgctcgacctgttcccggagaacgagccgctggcccggtggatccggatggccggtgagcgggtcgccttccaggggctgccggcccggatctgctggctcggctacggcgagcgggaccgggccggggtccggttcaacgacatggtggctcgcggcgaggtgtccgcgccgctggtgatcggccgggaccacctggactccgggtcggtcgcctcgccctaccgggagaccgaggcgatgctcgacgggtccgacgcgatcgccgactggccgctgctgaacgcgctggtcaacaccgcctccggggcgagctgggtgtcgatccaccacggtggcggggtgggcatcgggcgtagcatccacgccgggcaggtgtgcgtggccgacgggaccgcgctggccgggcagaagatcgagcgggtgctgaccaacgacccggcgatgggcgtgctgcggcacgtggacgccgggtacgagtcggcgtgcgccggtgacgtgcggattccgatgcgcgatgagtgacttcgcgaggctctggggagagatcgccgggatcgggcgcgcttccagcggaggatatctgcggtacgcgctgacgccgccggaaatgcggctgcgggagtggttccggggtcaggcggggtcgcgggggatgaccgtgaccgaggacggcaacgggaatctgttcgcctggtgcggggagccgtgggcgccggggaccgtgctgaccggctcgcatttcgactcggtgccgcacggtggcggttacgacgggccgctgggcatcgtgggtgcgttcctcgcgctggaccaggtcggacattcccgaaatatcgcgattggtgctttcgtcgacgaagagggcgggcggttcggcgtgccgtgtctcggctcccggctgctgaccggggcgatcacgccatcccaggcggccgcgttgaccgaccgggacggggtcagcttcggggaggcgctcgggagtgtgccaactgggaagatcacctcaataagtgacatatcagcctttgttgagctacatatcgagcaggggcgtgcgctcgaagtcccggtcggcgtcggcagcgcgatctggccgcacggccgttggcggctggagttcgccggcgccggtgaccacgccggcaccacccggatgaccgaccgccgcgatccgatgctcaccttcgcctacaccgtgctggccgccaacaaggaggcccgcctgctcggcgcgcacgccacgatgggccgggtccaggccgagccgaacgccaccaacgccatcccgtcgctggtccacggctggctcgacgcccgggccgcggacaccgccacgctcgaccggctgctcgaatcggtgatcaagaaggcgaccgagcgggccggccgggacggcaccgacctgaccgtggtcgccgagtcggtgaccggcgaggtggccttcgacacggagctggccgggcgactgtccgcgctgctcggtgacgtgccgatcctgccgaccggcgccgggcacgacgccggggtgctgtccgcgcacgtgccgaccgcgatgctgttcgtccgcaatccgaccggggtgtcgcacgcgccggccgagggggcctcggacgaggactgcgaggcggggatcgacgcgctggcacgggttctggaggcgctgacgtgacggcctatgtcgcgcagtacgcctggatcggcgacgaggtcagagagaatgtcggcatcgagatcgccgacggccggataagccgggtatcaaccgggatttcgggtgaaaggctgtcgggtctcgttctgccggggatggcgaacgcgcactcgcacgccttccaccgcgctctgcgcggccgcacccacggcgaccgcggcagcttctggacctggcgcgacctgatgtaccgggtcgccggccgtctcgacccggacaactacttcgccctggcccgggcggcctacggcgagatggcgctggccggcatcacctgcgtcggcgaattccactacctgcaccacgggccggacggcacccggtacgccgacccgaacgcgatgggtcacgcgctgaccgccgccgccgccgaggccggcatccggatcaccctgctcgacgcggtgtacctgaccgccggtgtcgacggcaagcccctcgacggcgtgcagcgccggttcggcgacggcgactacgacgggtggtattcccggttcgacgccctgcgcggcggtggccacgtccggatcggcgcggccctgcactcggtgcgcgccgccccggcggacgggatggccgccttcgccgcacgcaccgacggcctgccggtccacgtgcacctctccgagcagccggccgagaacgagcagtgccgggcggtgcacggctgctcccccaccgaactgctcgacgccatgggtgtctggcagccgatgaccaccgcggtgcacgccacccacctgaccgacgccgatcgcgcgctggtggagggcagccacgcctgtttctgccccaccaccgaacgcgacctggccgacggcatcggcccggcccgcgccctggccgacggcggcaccacgctgaccctgggcagcgacagccacgccgtgatcgacctcttcgaggaggcgcgcggcctggagctggacgagcggctggccacccggcagcgcgggcacttcaccgcggccgagctgatcaccgcggccacccgggccgggcacgcgtcgctgggctggtccgacgctggagagattgccgtcgggcagcgggccgacctggtcgcggtgtccctggacagcccgcgcaccgcgggcatcgacccggccgggacggtcttcgcggccaccgcggcggatgtcaccgacgtgatcgtggacgggcgaccggtggtccgcgacggacggcatctcggcatggacgtgccggccgcactgcgctcggcgatcgcggcggtgctgtgatgagcctgctgatcacgaacatcggcgaactgttcaccaacgccgaacgggacctgatcccggacgcggccgtggtcgtcgacggcgaacggatcgcctgggtcggcccggccgccgaggcgcccgccgcggaccagcggatcgacgccgagggcgcggcggtgctgcccggcttcgtggacagccatgcgcacctgatgttcgccggggaccgggccgccgagttcggcgcccggatggccggcgagccgtacaccggcggcgggatccggaccacggtccgggccacccgcgcggccaccgacgaacagctgcgggccaacgcccggcggctggtccgggaggcgatgcggcagggcaccacgacgatcgagatcaagtcggggtacggcctgaacgtcgccgacgaggcccggtcgctgcggatcgccaccgagttcaccagcgagaccacgttcctcggggcgcacgtcgtcccggtcgagtaccaggaccggccggacgactacgtcgggttgctgtgcgggccgatgctggcgatggccgccccgcacgcccgctgggtggacgccttcgtcgagcgcggcgcgttcgacgccgaccaggcccgcgcgatcctggagtccggcaaggagctcggcctgggcgtccgcgtgcacggcaaccagctcggtcccggccccggggtgcggctggccgttgagctggacgccgcgagcgtcgatcactgcacccacctgaccgacgcggacgtggacgcgctggccggcacccggatggactgcatgtgtgcgtgcggcgggatgaccaccacggtggccacgctgctgccgggcgccgagttctccacccgctcgccctatccggacgcccgccggctgctcgacgcgggagtgaccgtggctctggccaccgactgcaaccccgggtcgtcgtacacctcatcgatgtccttctgcatcgccctcgcggtccgcgagatgcggatgacgccggcggaagcggtccgggccgcgaccctgggcagcgcgcaggcgctgcgccgctccgacatcggcgtgatccggcccggcgcgcgcgccgacctgctgatcctcgacgcaccctcgcacctgcacctggcctaccggcccggtgtacccctgatccgcaccgtgatccacaacggagtcgtgcaatgaccgttatcgttcaacccaccgggatcgaccccgccgacgtcatcgccgtggcccggcacgacgccaaggtggagctctcccccgccgccgtcgaggcgatggccgccagccgcgccatcgtggacggcatcgaagcctccggccgccccgtctacggcgtctccaccggcttcggcgcgctcgccaacacctcgatcgccccggaacgccgggccgagttgcagcacgcgctgatccgctcgcacgccgccggggtgggcgcgccgatgccccgcgaggtggtccgggcgatgatgctgctgcggatccggtcgctggcgatgggccgttccggggtccggccggtgctcgcccagggcctggccgacctgctcaaccacgacatcaccccgtgggtgccggaacacggctcgctgggtgcctcgggcgacctggcgccgctggcgcactgcgcgatcgtgctgctcggcgagggctgggtgatcggcaaggacggcgcccgggcgtcggccgccgaggcgctgcacaccgccgggctgcgcccgctggagctggccgccaaggaggggctggcgctgatcaacggcaccgacgggatgctcggcatgctgctgctggcgatcgccgacgcggcgcacctgttcaccatggcggacgtgaccgcggcactggccaccgaggcgatgctcggctcggagcggccgttcctgcccgagctgcacagcatccggccgcatccggggcaggcggcgtcggccgccaacatccaccggctcctgcaggactccgcgatcatggactcacaccgggacgacctggcgcacgcggtgcaggacgcctactcgatccgctgcgcgccgcaggtcgccggggcggcgcgggacaccctcgacttcgtccgggtcaccgcgtcccgtgagctcgtctcggtggtggacaacccggtggtgctgccggacggccgggtcgagtcgaccggcaacttccacggggcgccgctcgggttcgccgccgacttcctggccatcgccgccgccgaggtgggcgcgatcgccgaacgccgggtcgaccggctgctcgacgtgacccgcagccgggaactgccgccgttcctgtcgccggacgccggcgtcaactccggcctgatgatcgcccagtacaccgcggccgggatcgtcgccgagaaccggcggctggccggaccggcctcggtggactcgctgccgaccagcggcatgcaggaggaccacgtctcgatggggtgggcggccactaagaagctgcgcaccgtgctggacaacttgaccagcctgctcgcggtcgaactgctgtccgcggtgcgcggactgcagctgcgggcgccgatcacgccgtcgccggccggccgggcggcgatcgccgcggtcgagccgttcgccgggcggccggggccggacgtcttcctggcaccggtgctggagcagacccgggcggtgatcgccgcccgggatctccggaccgccatcgagacggcgacgggtccgctgggctgacccggacgccgcccgatcagcggggcagttccttggcgacgaccttggccagctcgcggaacgccttgccgcggtggctgatcgcgtccttctccgccggggcgagctcggcgttggtccggtcctggccgtcgccgaggaagatcgggtcgtagccgaaaccgccctcgccgcggcgcgcgcgcagcagccggccggactgccggccctcgaccagatgctcccgcccgctcggcaggaccagggcggcggcgcagacgaacgaggcgccgcggtgctcgtcaccgacgtcgccgatctgggccagcaccaggtccaggttggcggcgtcgtcgccgtgcccgccggaccagcgggcgctgaacacgccgggcatcccgttgagcgcgttcaccgccaggccggagtcgtcggcgacggtcggcaggccggtgcgcttggcgccctcgcgggccttgatcagcgcgttctccccgaaggtgagcccggtctcgggcacgtccgggtagcccgggaagtcgcccaggccgaccagctcgatctggctcatgccgagcgcggcgtccaggatgcgctgcagctcgatcagcttcttcttgttcgcggtggccagcagcagccgcgcgctcactctgcagtccttggcatgctctcctggccctcgcctgcgagtccgtcgttcacttccggctgcggccgctcggtgcagtcgatcatgccgcaagggccttctgctgcgcgacggccagctcggcgcaacccgcgagcccgaggtcgagcatggcgtccagctgggcgcgcttgaagacgccgttctccccggtgccctggacctcgacgaagtcgccggcgccggtgcacaccacgttcatgtcgacctcggcggcgacgtcctccacgtacggcaggtcgaggcgggcctcgccgtcgatgatcccgacgctgaccgcctggatcgaggtgtgcagcaccttgtccaccttgccggccagcgacttgcgcccggccagccaggtcaccgcgtcgtgcagcgccacataggcgccggtgatcgcggcggtgcgggtgccgccgtcggcctgcagcacgtcacagtccaggacgatggaattctcccccagcgccttcagatcgatgcaggcccgcaggctgcggccgatcaggcgggagatctcctgagtacgcccgccgaccttgcccttgacgctctcccggtcgccgcgggtgttggtggcccgcgggagcatcgcgtactccgcggtcagccagcccaggccggagcccttgcgccagcgcggcaccccctcggtgacgctggcggtgcagagcactcgcgtgttgccgaactccaccagcaccgatccctcggggtggatgctccaatgccgggtcagcgtcaccggtcgcagctggtcggccgctcggccgtcgggtcgcgccatgaccccaaccctatgcgtaccgcggtgtgcccgcttcgtccgccccgggttcgcgggtccacgggatgctcgcgcgggattccggggccgccgggcggatcagcgaggggccgggaccggggtcgacggcgtgcgcgcggaggaaaccctcgaccgcgcgcggccagccgaagcgttccgcccgggcgcgggccgtggcccgccatcggtcgcgggggcgttccagcagccgggagatgccgtcggcgaaggcctccggggtgcccggcaccgcgatgccggcctcgccgatcacctcgggcagcgcgctctgctcgtcgaccaccgccggggtgccgcaggccagcgcctccagcgcggacagcccgaaggtctccaccgggccgggcgcgaccaccacgtcggccgaggcgagcagggcggccaccgccttgcggtcggcgatgtgcccggcgaaccggaccggcagccgggcggcacggtaggccagggcggcccgccgggtgccgtcgccggccaccaccagcaccgccggcaccttgttgttgcgcagcacggccacggtgtcgacggccagctcggggcgtttcgcggcggacaggcgactcgcgtacaccaccagcagttcctcgggccgcgcgtagcgcgagcggaccgacacgtccatccggctcgggtggaacagctccaggtcgacgccgagcggcacctcgaccagattcggcacgcccagccggcggaactcggcggcggcgaacgcggtggtgcagacgatcgtgtcgaaggcctcggcggtgcgccggttgaaccggtcggcgagcgcgtcgcgtttcggcatgccccagacgccgagcaggccggccaggctctcgtgggagaccatcatcgatcgcaccccgcgctgcttggcccaggtgccggtccagcgcagcgtggtgcggtcggagacctcgatgcggtccggctccaggctgtccagcaatttgatcagctcacgccgaccggccagcacgcggtagccgccggtgcgcggcaccggcgcgctgggcagggtgatcacccggccctgtgcggtctcctgatcccggaactggcgaccggggatgatcaggaccgcctcgtggcccgcatcctggtatcccttgccgagctcgcgcagggtggtccgcaggccgccggtatgcaccgtgacgaagttggccaggcgaactatgcgcatgtaacaactccaaggtcacgacacgaggtgcaccggtgtaagccgatcccacccccgtaccggctcagagatcgtatctggcacccgggcggacgacttccaccggtcccgcgtatgcggctccggctgcctccacgatagtggcctcactggcccacgccggcaccagatgtgtcagaagcaatcgggcgacgtcggccttggtggccgcctcccccgcttcgccgccggtcaggtgcaggtccggcggattctccacaccgtccatgtagctggcctcacacaggaacaggtcggcaccggcagccagccgcagcagcgcctcgcagggcgcggtgtccgacgagtacgccaggacccggccgttgtgctcgatccggacgccgtacgtctccaccggatggttgacccggtcgaccgtgacggtcagcgggccgatcgggaaggtgcccggctgcaggccgtagaacgtgtagacgtcgtcgaccggctccccgtcggcgctgtacgcggcggcgatccgctcggcggcgccgagcggcgcgtacaccggcagcgccggcagcggaccggccgggtcgtagcgccggacgaccacataggtgcacgcgtccagcatgtgatcacagtgcaggtgggtgagcaggatggcatcgatcgcgcgcatgtccgaataccgctgcagggcggagagcgcgcccgacccgaagtcgatcagcagccggaatccctcggcttccacgagataggccgaacaagccgactcggggccggggaaactgccggcacaaccgagaacggttagtcgcatgcgggtccctctgactcacaccgggtcggccattccaaggtcgtccacgccccgcccgaccggtctgcgctggacttgtcagaccagtcaatcacggtgcgaagcgtacgcgctgaccgctgcccgacgttaacaactgatcgatttgtcgctaaatcgacaacgcacgtcacaggtgctgtgacctgggtcctgaccatttttaccgtcacgtccggtaagccctccgcgttgctcagagtgaggacccgagaacgatcagatggaggcgacgtgaccgcggtggaaccggccggcatcaccagaaccgcggtacccgaaatcctgccgttcgaatcgtcctgggaaccggtgccgtgggatccggacggcccgattttccgatttccggccgaggacgacccggctcccgacccgcaccgggtgctcgccatggccggatactgcgcgatgctcggcctgaccggggtcggtgccggcctgtacgcgctgatcgccgtgttccgtggcgcgcccggctggtacctgccggcgctggccctgctcaccatggtcagtgtggggctggtggtcggcgcgttcctcgccgtccaccagcgcaccctgccctggatcctgctgctcgccgcggcgccgccgatgttcgcggcgctcttgttagcggtggcctattaggcccacagctggccttcaagagcctcttcggcgtcgttgagcgtgccgccgtacgccccggtcgacagatatttccagccgccgtccgggatcacgaacgcgacgtcggcccgcttgcccgccttgaccgcctcgtgcgccacggccagcgcgccgtgcagcacggcgccgctggagaagccggcgaagatgccctcgacctcgaccagctgacgagtccgcagcacggcgtcccgggtgccgaccgagaaccggcggtccagcacggtggcgtcgtacagctccggcacgtacccctcgtcgatgttgcgcaggccgtagaccagctccccgtaccgtggctcggcggcgatgatctggatgccgtcgaccttctccttgaggaagcggccggtgcccatcagcgtgccggtggtgcccagcccggccacgaaatgcgtgatcgtgggcaggtcgtgcagcagctccggcccggtcgtctcgtagtgcgcgcgggcgttcgccgggttgccgtactggaacagcatcttccagtccggatgctcggcggcgatctgcttggcggtggccaccgcctggttcgacccgccggccgcgggcgagaagatgatctccgcgccgtacatccgcagcagttgggtccgctcggcggagacgttctccggcatcacgcagaccagccggtaaccccggagcttggccaccatggccagggcgatgccggtgttgccgctggtcggctcgaggatggtgtcgcccgggcgtagatgcccggactcctcggcctcgcgcaccatgtacagcgcggcgcggtccttgatgctgccggtcgggttgcggtcctccagcttggcccagagccgcaccggcggcgccccctcgggcaccgccggggagaggcggggcaggccgacgagcggcgtgcccccgcaagcgtccagcaggctctcatagcgagccatcgaggatcagcgcccgaagaaggcggccgccgccgcgaagcccagggcgccaccggccacggccgggaggatggtgatcgagtcaccgtcgttcagcttcgcgtcgagcgcgccgaggaagcgcacgtcctcgtcgttgacgtagatgttgacgaagcggtgcaggccgccctcggcggtgatcagccggcccttgatgccgctgtgcttggcgtccaggtcgtcgatcagcgcggagaggttgtccccggcaccctcgacgatcttggaaccgccggtgtagctgcgcaggatggtgggaacgcggacttcgatagccatgattgtcaagctcctagagagtcgtcatgcgggcagggcggtcgggaggtcggggtctaacggacccggcgacactcgtagaacaccgacgccgggctctgcccgaacatgtacgactgcacggcactcaccttcacgacttcaccgtcgcatccacgatgttgacctcttcctcggtcaccacaccgtccacgatacggaacgagcggatctcctcggaatccggctcacgggtcgagacgagcagatagtgcgcgttcggctcaccggcgaacgagatgtcggtgcgcgaggggtaggcctcggtggccgtgtgcgagtggtagatgaccaccggctcctcgtcgttgtcgtccatctcgcgccagacccggaagtgctccatcgagtcgaactcgtagaaggtcatcgaccgggccgcattgtccatcgggatgtgccgggccggcacgtcactgccgatcgcgccggcgaccacgccacaggcctcgtcgggatggtcccggcgggcgtgggcgacgatcgcacgcacgatcgcactgtcgatggtcagcacggcgttcacattaccgaaaggtttcgccactccgcgcgtggcgaggcacacacctatttgatctccggcagcgcattgaggagtgattcctgtagataaccgaggtaggcgtaaacggacagctggaacacccggctggaacccggatcctccagcaccgcgtcgtccagttcctcggccagatcggtgtcggcctggatgtccagacgggtgcccatcgccagccgggcgtcgttgatcgcgcgcagccaggcctcggcggcctcaccgtccagccgcacctcgccctcgccctcgtcgggtagggcggccaggatcgcgccggcctggtcgatcttggcgcttttcaggtcgctctcggtgtacagccggaattcccgggaatcctccgggcgctccggatagatgtccgggaagagacggcccaccaccgggtcggtgtggtccatcccgtcggtcagcaggcccaccacctcggcggccaccttccgcaggacacgcacctcgtcgtgcgcgaacgtggccacacactgaccgccgctgcgtcggaacatgctcttccccacccgctttgtcaggctcggtccacagttgcccagagaccgtatccgtgcagttggttggcgtccatctccatgcgctcgcgggcgccgctggacaccaccgccttgcccttggtgtgcacgtccatcatcagcctctcggccttttccttactgaacccgaagagcttctggaagacccaggtcacgtacgacatgaggttgaccggatcgtcccagacgatggtcacccaaggccgatcctcggccggtacttcctcgatctccggcgtctcgacgggagcaacctgaggcaacgccatgcccccatggtgccaccggatccgccccaggcgtgaaccggagcaccgaacggcaggtcgcgacgccctcccggggcacgcattagggtagggatcgtggagacgatggggccggccctgctgaccgatcactatgagctgaccatgatcagtgccgccctcaaggacggcaccgccgagcggcagtgcgtgttcgaggtcttcgcgcgccgcctgccgaccggccgacgctacggcgtggtggccggcaccgaccggctgatcgagatggtcgccggtttccggttcgacccggccgagatcgagttcctgcgctcctcgggtgtcgtcgacgaggccaccgccacctggctggccaactaccggttcaccggcgacatcgacgggtacgccgagggcgagctgttcttccccggctccccgatcctcaccgtctccggcagattcgccgagtgcgtggtgctggagacgctgatcctctcggtgctcaaccacgactgcgcgatcgccgccgccgcggcccgaatggtcaccgccgcccgcggccgtccgatcatcgagatgggctcccggcgcacccacgagcaggccgcggtcgccgcctcccgggccgcctacctggccggcttcgcctccacgtcgaacctggccgccggccgcgcctacggcatcccgaccaccggcacctcggcgcacgcgttcacgctgctgcacgacgacgagccgaccgcgttcgggtcccaggtcgcggcgctcggcaagaacaccacgctgctcgtcgacacgtacgacatcagccagggcatccggaacgcgatcgcggtcgccgggcccgacctgcgcgccgtccggatcgactcgggtgacctgtcggtgctcgcccagcactcccgcgagctgctcgactcgctcggcgccaccgagaccaagatcatcgtttcgggtgacatggacgagtactcgatcgccaccctcgccgccgaaccggtcgacatgtacggcgccggcaccgcggtggtcaccggctccggggcgcccaccgccggcctggtctacaaactcgtcgaggtcgccggccgcccggtcgtcaagcgctcggagaacaaggccaccgtcggcggccgcaagaccgcggtgcgccggcacaaacccaccgggaccgccaccgaggagatcatcgtctcccagggggtgcccgaccaccaggccaacgaccggctgctgcagcgcccctacatcaccgggggcgaggcgcagacccgacccaccctgcaggagtcccgcgaccacctgcgccgcaacctgatctcgatcccgtgggagggcctgaaactctccgcgggcgacccggccatcccggtcatcctcattcccaccgcataggggccaccccatgactcgcgcgctgatcatcgtggacgtgcagaacgacttctgcgaaggcggctcgctgccggtcgccggcggcgccgccgtcgccaagggcatctcgctggtcctcgacagggccggcgaccgctgggaccacgtcgtcgccaccaaggactaccacatcgacccgggcgcgcacttcagcgccagcccggacttcgtcgactcgtggccggcccactgcgtcgccgggtcctcgggcgccgacttccaccccgagctgatcaccgaccggatcgaggcgatcttccacaagggcgcgcaccaggcggcgtactccggcttcgaagggcacaccgaccagggcgaaaccctcgccggatggttgcgggcccgggcggtcaccgacgtcgaggtcgtcgggatcgcgacagatcattgcgtacgcgccaccgcgctggatgccgccaccgaaggcttcgccaccaccgtcgtcctcgaactgaccgcgggtgtggcggcggccacgaccgaggcggctctggccgacttccgcgccgcggcggtgtcgatgaccggagccccgatcgtcgacccgatgtgacccgcgtgcccgacgagacgccgcccccttcggccaccacggcaccgccttcttcgtccgtggcggcggcgccgttgtccccatccgcgccgtcatcgtcgccttctccggccgcgcccgcttcggtcgcgcccgtttctgccgcgcccgtttctgcggcaccttcggggttggcgcggccttctcggggcgtgctggccgctcgccccgcggctgtcatccggcccgtggcggacggtgattgggggcaggtgtggccgatcgtccgcgaagtggtgcgggccgccgacacctacccgttcgacccggcgatgaccgagcccgaggcgcgggccatctggctggagcagccgcccgggctgaccgtggtctcgaccgagccggcccgcggcggggcggaccacgacgtaccggcgaacgggtctccaccggagaagatcaccgggaccgcgaagatgggcccgaaccgcggcggacccggcgcccacatcgccacggcaagcttcatggtcgccgccggcagccgcggccggggcatcggcgcggccctctgccgctacgtgatcgactgggcgcggaccgaaggctacgccggcatccagttcaacgccgtcgtcgccaccaacacggccgccgtgaccgtctaccgccgcctcggcttccagatcctcggcacggtcccgcgcgccttcgaccatcccacccagggccgcgtcggtctccacctgatgtacctggaattcccacggcacggcgggcacaccggctgatctcgggcgccgacaccagccgcagggtccaaagaccagctcccggaatcgtcggccgcctcgcaacgaggtcgacgaccccggaccggccgtccgcgggtgcgtaacggccggtccggcgacggtcagcgcagaattccggcgagaatgtcgatctggcggggatcgtcggcgtagcagtagaagacgagttcgtcggccccgaactcccgatacgccgccactgcctcggcgatctcccccggatcgctcagcggcacgccgaatccgggacgcccggtgaaggcgtagtagtcggccaccgcccgcctgccccgctcgaccgtcgcggcatcccccaccgacacattgatctggcagaccagccggggccgccccgcccgccccgcttcctcccactgttcattgacagtacgaaccaatcctcctgcccatcccaacggcgccgcacagatgaacccgtccgcaaaccgcgccacccggcgcaacgccgccggcgcgaatcccccgatcagaatcggcggcccgtcccccgcaaccggccgcggcccgatcccggcgacaccggcggccactcgccgcccgagcccccagtcatcctccgtggaaggcgccactccggatcccccggaccgcgacaccacaccggacccacccggccgcccagcaccatcgggcccgccgggaccagcggtttccgtgccaccgggatgttcagcgcggcggtggcggagggggtgacccgcgccgtccggggcgaccgaccggtcgcgcgggtccggggtggtcgcggcgcggtagggctcgccgcgccagatccttcggaggtcggcgagctgggcgtcaaggagacggccgcggcccgcgagggggacaccggccgcctcatgatcgtcctcgcggccgccgatgccgatgccgaggacgaagcggccgcctgacatccggtcgagggtggcgacctgcttggccagcaaggccgtcgaccgcagcgggccgagcagcacttcggtctgcaaccggatccggtcggtgccgccggccaggacggcgagggcgatcagtggctcggggttgtcgaaggtgaggcggtccagcagagccagcgtggcgaagtcgtgctgttccgcgagccgggcccaggcgggcagcagagcggggtcattgatgggcaggccgaggccgaactccatggtcatcctccagaaggcaggcagcaacagatgacgtcgccacctcctccccgctcacggcgaggtcccgagcccacccgcgacatgtatccagggctcgaagatgcggagttccatcccgaccctacccacgggcattcaccgccgccagccggatttcccggccctgccggccctgccggccctgccggcagccccgtggacatccggagccggccgggttcccgcggccgcgggaaccgacatcacccgagaggggacgcacgagcgggagcagacgcaagccccggcggaagtgcttagaccgaggtcgcctcaaccggggcaaccggcgccggaatcgcctcggccgaggcggcccggaccgaagcgatcggcgccgaggcggcctggaccgaggcaggcgggaccgaggcaggcgggaccgaggcaaccgcggtcgaagcgaccggcgccgaggcagccgggggcgccccggttgaggtgggctgggccggcgggttgtcgcggcggcgacggagctcggccgggatgacgacgagggcgaccaggacgccgaccgtgcccacggcggtgaagccccaccccgggccccacgagtcgatggcgaggccggccaacgggccgccgagggcgacgccgacggtgagggcggagttgtgcaggcccatggcttcgccgcgggcggcggcggggatcatctggctgacggcggaggaactggcggtgatggtgggggcgcagagggcgccggccgggatgagcaggacggccaggagccaccagtgggagccgccgaggccgaccgggacggtgaacacggccatcgggatgaacagggcgaggaccgggaggccgcgccggacggtgccgtaggcgaagccgccgatcagggagaacagggcccacagggtcatcacgaggccggaccagctgagctcgccggaggcgcgcaggacggcgacgacggacacgtcggtgccggacaggacgagggtggcggccatggtgacggccaggatggcgatgaagcggggcttgagccactcgcggcgggcgacccgctcgccggccgagaccggggcctcgtggtcggcccgggtgggcgggttgaccagccacaggccgaggccggccagcaggatgccgccggccagggcgagcatggcgacgcgcgggccggcgtggtcggccgtggagatcagcacgccgagggccgggccggccatgaacgacagctcggtggtcatcgagtcgagggcgaaggcgggcaggcggtgcgactcgggggtgagcgcggcgatcgactgccgggccaccgagaacgccggcagggccaggaagccgccgatcacggcgaccgggagcagcgcccagtagggcagcgcctgcgcgacgatccagtagatcacctcggcgacggtggtcagcaccaggaccggccgcagcccgcgccggtcgacgagccggcccatcatcggggcgccgagtgacccgccgagggtcgccgcggcaccgaccaggcccgccgcgccgtagccccggcccaggtcggtgacgacgtgcagggtgagcacgacggcgccggccgcgatcgggatgcgcgcgagcgtggcgatcgcgagcacggacatgaccttgggcagtgcgagggtttcccggtaaggcttgagcaacatgacgatcctgacctccgccgccgatcctctcccaggggtacgacagaaaccaatccgtttagtgcagctcacgtccccgatccggcgccaggcgcaaaaagccggaaacagcccggcaaccgaagctcacccgccggcgcggacccgacccggagagtcaccgaacaggccgggtccgcgcggacggtcctgaggcgcgcagggccacgaatcgaggtttacgaagcggtccggctgaggaacgtcgcccccaccttcagcgtcgtgttggtgcctccggcccgatatccggccacccgcccgcgcacgatgccgctctccagcaccaccgtcgtcgcgttgtccacgctcaccccgtactgcggcgtcgtgggtccggtcttgtcatcgttcgtcccggtctccacggcgagggcgctgaccagcaccgccgtcgccaccggcgccgccgccgtcccgttgatcttgagtccggcgtagccgccgttgtcgctcttgccgtcccggtttaggcgcagcccgttgagcacgatgacgccttcgccggtgctgttctggtcgatgctcaccccgttgaagccgttgcggtcggtgctgcagccgagcagttccacgatgccgttgccgccgcgcaggtcgaagccgttgtgccggctccattccgagcggcagttggtgaaacaggagttgccgcagccggcgatgaagaagccgtggctgccgccctcgatcgactccaggtcggtgaactgggagtcggtggtgttgttgaagctgtaggtgatgccgccgttgcccttggccgcgatccgttcgaagcgggccgagtacagcgcctgcgggccgccgtcgctcggcgtgcggtacgcggtggtgatggcgtggttcggaaagtcgaagatcgcaacgtcgcggaccaccacgccgtggatcttgccggtgaagcggatgccgtcgacgccggtgccggcggccagcgcggatccgttcagggtgaggtggaacagccgctgctcggcggaaccggccgggtagccgccggtgtcccggtcgacgatctcgatgcacgccgggccgctgaacgtgtcgagcggtttgatccgcgactcggtctgcacccaggtcttgtcgccctcgtcgatgtggttgccgtgggtgccctgcagggtggtggccgggtggacgcgcagcgccttcgacgtccggtaggtgccccgcggcaggtacacgatgctgccggtccggcccggcgccgccgcgtagtccagcgcggcctggatggccgcggtgtcgtcggtggtgccgtcacccttcgcgccgaattccttgacgctgaacccgaggtggccctcggcataggcgggctcgtccccggcggccgcggccgggccactgccgacggccgtcgcggcgacccccatcgcggccgccccaccggctcggatgaacatccggcgattcgtcatgcgtcgctcccccgttcgatgcactcatgacggtgcatatccacgacgatggtcgcattcgcggccggcgggcagaaacgacgaagcggcccgcaccggagtgcgggccgcttcacgacgggatgaccgtcagtcgtgctggatgtcctcggcgtagctggcgccgccgtccgactcgtgggtcagcgggcgggcgccgccctccggcggaccggcgagggcaccgtactcgccggccgcgagctccgggaacttcaggtcgaaggcgggccgctcggagcggatccgcggcatccggtcgaagttgcgcagcggcggcgggctgctggtggcccactccagggagttgccgtggccccacgggtcgtcggcggtggcgacccgcccgaccttgtaggacttccagatgttgtagaggaacggcagcgtggccaggcccaggatgaacgagccgatcgtggagatcgtgttcagcgtggtgaagccgtcggtgggcaggtagtcggcgtagcgccggggcatgcccttggtgccgagccagtgctgcaccaggaaggtggtgtggaagccgacgaaggtcagccagaagtgcaccttggcgagccgctcgtcgaggtaccggccgaacatcttggggaaccagaagtagatgccggagaagaccgcgaacacgatcgtgccgaacagcacgtagtggaagtgcgcgatcacgaagtacgagtcggacacgtggaagtcgatcggcggggcggcgagcagcacgccggagagaccaccgaagaggaacgtcaccatgaagccgatcgcgaagagcatcggcggctcgaagctgatctggccgcgccacatggtgccgatccagacgaagaacttcatgccggtcggcaccgcgatcaggaagctcaggaagctgaagaacggcagcagcacctggccggtgacgaacatgtggtgcgcccacaccgacatcgacagcgcgccgatcagcagggtcgcggcgaccaggcccttgtagccgaacagcggcttgcggctgaagaccgggatgacctcggtgatgatgccgaagaacggcagggcgatgatgtacacctcagggtggccgaagaaccagaagaggtgctgccagagcatcgggccgccggtggccacgtcgaagacgtgcgcgccgaggacacggtcggcggcgagcgcgaacagcgcggccgccaggaacgggaagaccatcaccgcgagcagcgccgtgaccagcatgttccaggtcatgatcggcatccggaacatggtcatgccgggtgcccgcagggtcaggatcgtggtgatcaggttgaccgagccgaggatcgtgcccagaccggagatggccaggccgaccacccacatgttgccgccgacgcccggcgagtgcagcgagtcactcagcggcgtgtaggcgaaccagccgaagtcggccgcgccaccgggggtgaggaagccgccgatggtgatcagaccaccgaagaggtacagccagtacgcgaacgcgttcagccgggggaacgacacgtcgggcgcgccgatctggatcggcaccacgtagttgccgaaggcgaacacgatcggcgtcgcgaagaacagcagcatgatcgtgccgtgcatggtgaacagctggttgaactgctcgggcgacaggagctgcatgccggggcgggccagctcggcgcgcatcagcagcgccatgaggccgcccagcaggaagaacacgaaggcggtgaccatatacatgatcccgatctgcttcgcgtccgtcgtgcgcaggattcgggcgaaggccgaacccttgacctgccgccggaccggatatggacgggtcgcgatcggcgacggcgcaacggtcgtcacgaattgcctccgttgtctcgttcgtcctactcggcacacctctgaagatcgggcgtacctcgctggcgagaatagtcccccaccgactttccgccgtcgcggggtgaccaaagggccacgcaggactaacgcgacctgctatacggcggggacgagaccccggtagtggtcggtgaagatccgcaggccgcgacggcgcagcatcgggtcgcgcagcgacggcggcacgtccctggtccggtcccgctcgcgggtccggtcgcgcacctcggcgcatcgggggcggcggcgatcctcataggcacgcagcgcgaccgggatgtccccctccgcccggcgcagctcccggcccagcacgaagccgtcctcgaaggacatcgcggcaccctgggccagggtcggcgcggtggcgtgcgccgcgtcgccgaccagcaccaccgggccgcgggaccaggacggcaggaccacctcgtcggtgcgggcgaccgacaccttctcgatccggtcgaggatcgccgggaccggaccgccgaactggccgaacacctcgcgcagccgctcgatcgggtcggccgggtcaggggtgtcgggcgcggtctcgtcggcgtagcagtagatccggcgaccgcccatcggcatcgcgacgaactgggcgcgccggcccagcaccgcggtccagtcggtgagcggtggcccgccggagaccaccgcgcggtagacgatctggccggtgggcaccgcggggccgcccaggccgatccgctcgcggatctgcgagcggcggccgtcggcgccgatcaccaggtcgtactcggccatggcgccggtggagaacgccaccttggcggccccgtcgacgatctcgacgtcgcgcacctcggtgtcgtagcgcacctcgccgccgaccccggtgagcagcacctgctgcaggtcggcgcgggacagcgcacgggactcgccgaccccggcccagagcccggccacatccatctcgaacaggtcgcggccgcgcgcgtcgaggaagacctgccggaagatcaggtcacccagcgggcgcagcgggacgtcgaggccgagcaggcgcagcgcacgcgaggcgttgccgggcaggtagatcccggcgccggggctcatggtggccggcagggcctccaccacgtccggccggaagcccgccactcgcaggccccgagcggccgccagaccggcgatgccggcgcccaccacgaggatgcgcaaggtcatcggccaacgccttcctgtcgatggacacgcgtcggagccagaacactaccgcgcgcaacggtcacgggaaacccacgatcaacatcgacaccccgccccggcgtcccccggccgggtgtttctccggcggcgaaggcgcgaccggcgcgggccggcgcgaccgcccggcggaccccgatcgcctggcgggacggacgcggctcaacagtcatgcgacacccgaccatcggggtacgacgattccgtgcgggcgggccggacggcagaatcggaccatgccggaccgcctggacgaataccgccgcaagcgggatcccgcccgcacccccgaaccggtgccgcagtcgccaccggcgccgcgcgagccgggccgacgcttcgtcatccagcagcaccatgcccggagcctgcactgggatgtccggctggagcgggacggcgtgctcgtctcgttcgccgtcccgcgcggcctgccccgcgatcaggcccgcaaccacctggccaaacacaccgaagaccacccgttggagtatctggacttcgccggcgagatcccggccggcgagtacggcggcggccggatgaccatcttcgacgcgggcacatacgagaccggcaagtggcggtccgacgagatcagtgtcacgtttcacggtgaccgcacgaaggggcgatacgtcttcttccagaccgacggggcggactggatggtccgccggatggatccgccggagccgggctgggagccgatgcccgccgacctgagtccgatgctggccacccgggccggcacgctgccgcccgacgacgccgactggggctatgagctggcctggggcggccagcgcgtactgacgtacctgagcggcggaagagtgcggctgagcggacccggcggcaaagagctgatctcgctgtttcccgaggtccgggccttgggcccggccctcgctccggtcgaggcgatcttcgacggcgagctggtggccttcgacggcacccgtccggcggccgaccagaccgctcgcacggccaggaccagaaacccccgacccgttcaattgctgctgtacgaccttctctggctggacggtcatcgcaccaccgagctgctccgctacgccgagcggcgggaactcctggacgatctggccccggccggcccgcactggcagaccccgccgtacttcccgggcggcggtcgattcgccctggacgcggcacgttcgcaaggcttgtccggggtcgtggcgaagcggctcgattcgccctaccttcccggacgcacgacccgattgtggctggatatcgaggtgagttgacgggtaccccggttacgtaggacacatcagtggtaccgaagatgcacccggcagttcgttcagaaacgctgcggccggtccgatggcgggggttgccggcgaccgcagtggaaagggcctcgacttcacgatgcatccgtccccgtcgtcatccccggtcgccgatccgtccgccgagctgtggcagtccgcggtccgcgtgctggacaccaactggtccggcgaccacaccgtgccgtcgcgccgcctctacccgcatcagtggagctgggacgccgcgttcatcgcggtcgggctggcctacgtcaaccccacccgggcctggcgggacctgcgcagcctgttcgaggcacaatggccggacgggcgggtgccgcacatcgtgttcgacccggcgaccgccgaggacgactacttcccggggccgggtttctggaacgtgccggtctacgccggccggccggcgcggcgcagcaccggcctggtccagccgccgctgcacgcgctggccgcatgggaggtctaccgccacgcggcggcgcacggcgcggcctgcgtcagcgcggcccgcaccgagctggcctggctctacccgcggctggtggcccagcaggagtatctgaccgagcggcgcgacgccggcgggaccgggctggcctccatcgtgcacccgtgggagtccgggctggacaacagcccggcgtgggaccaggcgctggccgcggtgccggccgaccacaccctgctggctcgctatcagcggcgggatctggccgtgtcggacgccgcgcaccggccgaccgacgaggattacgcccgctatgtcgggctggtgctcagctaccgggactccggctattcggacagcgagctgatcgagcggcacccgttcgtggccgagtgcccggcgtacaacagcatcctggccgtcgccgaactcgccctggcgcagatcgccggagtgctgggccggccggccgacgccgggcggcaccgggaccgggcccgggagatcaccacggccctgtcccgccggctgtgggatccggcgagcgcctcgttccgggtccgggacgcacggaccgggcggctcagcccggcgcactgcgtgagcggcctgctgccgctgatgctgccggacctgccggccgagcaggtgcaggcgatcatggcggatgtccgctcggagcgtttccggctgccggtgccgagcgtggaccggacgtcgccggccttcgacccgcaccggtactggcgcggaccggtctgggtgaacgtgaactggctgctgcgccgcggcatgctggtgcacggtttccgcggtgcggccgaggagctgcgccgggcgctgctgcggctggtgcacgagcacggccactacgagtacttccacccggagaccggagagggactgggggcgccgaccttcggctggaccgcggcactctgcctggacctgctcgccgaccgctcggcgcccgcgtactcccggacctagaagacgaccaccgaccgcagcacctcaccggtgtgcatcttggcgaacgcctgctcgaccccgtccaacgggatctcctcggtgacgaacgcgtccaggtcgagccggccctgccggtagagctcggtcagcatcgggaagtcccggctgggcaggcagtcgccgtaccagctggacttcagcgcgccaccgcggccgaacacgtcgagcagcggcagctcgatcgtcatgtccggggtcggcacgccgaccagcaccaccgtcccggccagatcacgggcatagaacgcttgccggtacgtctcggggcggccgaccgcctcgaccaccacgtcggcgccgaaaccgccggtcagctcccgcacccgctcgaccacgtcgtggtcccgggcgttgatcgtgtgggtggcgccgaaaccgcgcgcccactccagcttccggtcgtcggtgtcgatcgcgatgatcgtggtggccccggccagcgccgcgccggccaccgcgccgtcgccgaccccgccacagccgatcaccgcgaccgagtcgccgcgggtcaccccgccggtgttgatcgccgcgcccaggccggccatcacgccgcagcccagcaggccgaccgcggcggcccgggcctgcgggtcgaccttggtgcactggcccgcgtggaccagcgtcttctcggcgaaggcgccgatgcccagggccggggcgagctcggtgccgtcctccagggtcatcctccgggtggcgttgtgggtggcgaagcagtaccacggcttgcccttggcgcaggcccggcaggtgccgcagaccgcgcgccagttgaggatcacgaagtcaccgggcgccacgtcggtcaccccggcgccgaccgcctccaccacgccggccgcctcgtggccgagcaggaacgggaagtcgtcgttgatcccgccctcgcggtagtgcaggtcggtgtggcagaccccgcacgtcttcacctggaccacggcctcgcccggtcccggatcgggcaccacgatggtggtcacctcgaccggcttccccttcgcccgggcgatcacgccccgcacccgctgactcatgcggcccaccctacggtcttttcagcagtgcttcagcaagcttgccgagctgccgtgcctgcgccggggtgagccggtcgaagaccaggtgctgcaccgccgcggcgtgcccgggcgccgtggcggccaccttcgcgaacccctcgtcggtgagcacggcgagctggacccggccgtcgccggcatgccgctcgcgccgcacccagccccgctcctccagccgggcgaccacgtgcgagagccgggacagcgacgcggaggcccgcttggccaggtgactcatcgggagccggcgatccggatcctcggagagcgtcatcatcaccagatagcccatgtgggtcaggccggcgtcgcgctgcagctgcgcctccagcgccgcggggaccttgaccagcacctcgaccaggctccgccagaccgcctgctgctcgtcggtcaaccagcggggctcgtccatgctggaaggttagtggcgttcggacagtgcggtatgggccgggcggacagcattccacagcgggtcaccgaatcgatcgacttacgtgaacctcagcgagtaggctgtccgaggactttccacctctgcaccgacgccggaaccggctggctggggggcctcggccggttccggcgtcgtgtgcctacagggcggcgtcgggcagctcacccgggatcaccggggaggggcggccgatcagatatccctggacgtaatcgacacccagctcgcgcagcatccgcagggtggcgtcgtcctggacgaactcggcgacggtgtggatgccgtacgcctggcagacctgcaccagcgcccggaccagcacctggtcctgcgggttgccgaccagatccaccacgtactccccgtcgatcttgacgaggtcgatcgggaagagccgcaggtagcggaacgacgcgtagcccgagccgaagtcgtcgagcgccagcgagcagcccaggtcacggatccggtcggcgaaccggcgggcctcgctcagattcccgatcagcgcggtctcggtgatctcgaaggtgagctgctccgggttcacccggtactgcgcgagcaggcgttccacctcgtcggtgagccgcgggtcgccgaccgagcggccggacaggttgatctgcaggcccatcccgggctgctcggcggcgagccgcatggcccgctcgaccacccacaggtcgatgtcgaagaccgcgtcgaggcgttccgcggtgtccagcacgtggatcggcgactgcgggccctccgcctcgtccagcacccgcagcagcagctcgtgtcgggtcacccggttgctctgcagctccaggatcggctgcgagtagagggtgaaccggtcggtgccgagcgcgtcggccacccgggtgcggtaggagccctgccggtcgcgggccggcaccgggtgcgcgatcagggtgagtggccgttccgcctcgcgggactgccgccaggcctgctccgcgtcgatcagcagatcgtggctgcccgcctcggcgtccggccggaaccggaccagaccgccccagaccagcgccccggactccgcgcgcatcgtgtcgaccagcgcggccgcctgcttgcgggccgccgaccaaggggtaccggccagcagcaccgcgatctcggcggtgccgacccggccgagcagccggtccggcccgacccggcactccagcagccgggcggcgccgcgcagcagctcctcccccgtgccctcgccctgcacccgcagcaccagcaacgcaccggccgcccggcgcagcgcccggtcgatctcgtcggcgaaccgggcccgggtcagcagcccggtcaccgggtcggggtcgaccagcgaggactggacggtctccccgcgacgggtgagccggacgtcctcgcggcgggcgcgttcccggtcggtgacgtcgcggatcgtgccgcggatgccgcggaccgtgccgtccgggctcatcatcggctccagccggcagtccacatcgaaccagccgccgtcggcgcgcatcaaccgcaccgtggcccgcaccggcgtccgggtggtccacgcctcggtgatcgcgccgagcgcggtggccaggtcgtcccggtgcacgtagcgggtcagcagctcgcgggtccgctcccggtcggcgggcacccggccgagcatcgcggacagcggcgcggaccagacgatctgatcactggccgcggtgtaggagaaccacgcggcgcggtcctcgaccggcgggcgcggctcgggcagcgaggcggtcggaggcgcccaacgctcgcgttcttcgggcacggtcatccgacggcacctcccccctcgcgcacgactgctccgcctgccaccaagacccctcacctattacgacctgtcaccgggccgtagtaacagtggacgccagcgtcaaagttttgacgtatccgtcaggcaaggccaggagcagggaattatcgcccatccagagtaacgaaacaaccgaacggtggaccgctttccgccgcgaatccaccgaaaagcgtcgcgttctccatgacggacagtcactgctcgtgtcggccctggaaccatgtgcgatctcctacccgcaaggagccgtccacatgcacgccacgtttccaaaaccctgcgcagcgtgatcgtcactccgtggcgggcccgatcccccactcggcgatccgccgccggaccggccgcatcgccggcatccggtctcccgggtgggttcaaccggtcagacctcctcggggtcacggcctaccgcggaccggccgccgtcgagcgggatgacagccccgttcaggaagcggccgcgtcggacagcaggaatgccacaacatcggccacctccgccggacgtccccgccgcattgtcgacccagccccgcaacggcgccgcggccgcccgaactcccgcccagccaccgccaagtctcgccccatatcccgaccatccaccgtcggcaggtcccgtcccgcatcaaccatccgccgccagggaatccccccatccgcaccgccctctgccctgcaccgctggcctatcgatcgtgatcgtccaaccgtaagccggcgcggacataccggagtgcagcccgcggactccagccgagaaccgcagcctcgagacgacctgacacgcaaggcgggaaccagcaacgatcgatgccaccggaagctggagcgggatcgggtgatgccgtcggcacgcagggcggaaccggtggatgccgcccagggcggggggcgacatccaccgggcggctccggcccgccgcgggcggtggtcctgttgagtttcatcgaagctgaccctcagcccagcaccccgcagcctggagctcggccagcatgagccctgaagcccgggctggggccagactcctgccccggtcgggcttaggtggcgggcgggcttggtggccggcgggcttaggtggcgggcggcctgggctgcggtcggtctgggccgcggtccggccggtttcgggcccgggaacggggaagcggacccgttcccggaggcgcggagctccggtggatcagagcaaggttcgatgactcagaaactcggcgaacagcaagccgggtggtcagagagcccggcgaatcagcaagcttggcgaatcaaggcgcttgatgcatcagggatcgcggcggatcaggtagccggtggatcgggacaccacataccgatcaggggaactgcatgcgccgggggcgcgggatgaccggcggtgggagcggcaggtcgtcgaggtggctccagttgagcgtgccgttgtcggtggatttgacctcgccgaggcaggcgcggagcaggccgaggttgggcgccccggcgtacccggcgatgaccacctcgggcttcgggtcgatctgggcgatggcggcgcagatcttggccacctcgcgttcgtcgaccgcgtccagtggcagcggcgactcgatgggcgagcggcgccagggtggcccgaaccgcccgagcagctcccgtgcgagccggccgaacgaccggcccacctccgcgtcggccatcgacaggcgtgcggactgcccgtagcaccacgggaccacgatgtgcccgttgatcagcaccagctgatagaccgaccgcggcacgctgatgatctcggctccgggtagcgtgccgaggaagagcaccagctcctcgtacggcagcggccaacgcggattgcccaacacgcgctccacggtctgtgtcatggccgggtgcgcgtgcacctcacgatcgattgccgtgctcagcgcctcgggcacgcgagtccacagctcgtcggcgatcttgtcgccgaactgctcgaccagccaatcgctgggaccgacgagaacgtctggacgcatttccccaccaccaccgtccgtgatgtcgacgtcactgctggctagaagagttgcacttccgatgatcgactggaagggcccgcaacgagatcataaaaacaagcatgaatgaaatcgcgcatgccgaccaaaggctcgccacagcgacggggcatcgagccgagaagcatcgaaacttgcaacttgcgcatcgaagcgcgggcgcaagttgcaggcctgatccgcttttccccgtaccccatattgaacacccaacttatttccggccggtgacagagaagcaaacaggctttcgctcgccatgatcaaatagtccgtcacctgcgaaccggctacctggctgatcgtttccccacgcactccgaagtggacctgcgaaacggaaagttcttccatggcctgcaagccactttcatcgagatccacctgggcggacctggagctgtgcaaccgggcaaacccctgactcctacgcaactcgagacgaccctctgtcggattcccgtcagaaagccccactcgttgatcaaagagtcgctgcaaacgctctccgacacccacacccgcctaatgatcttgcccagcccccgcgccccctctccgatcttcacgggccgccccgagaccgccctcgatcacgcctgcgttcgccggaccccgaatgacttcacggaaggggaatggcaccgaaccacacggatcggaccgagacaaacggtcgacaatcccgacaccattcgcttccggcgcacccggtccacaatttccgcacacccgaatagcggaagcgtccgaggcgtgatcacccattgtcgcgaacgcatccccgtcgctgcccgtaccaaacctattgcgccatcagtttcggacccgtcccgttctgcgggccgaacaggccgccaccagcgcccgcccggtcgccgattcgagaccgaccgtgtccgcggtggccgcccgcaccgcctcggccggcgtcacccgcgccgcccgcacggtcgtcgggacgaccgcggcggtgtccgccggcgtccgtcgtcggatctcgtccccagctcccatccgagcagctcatcacgcggcccgacggtgacgctgaccagcccgtccgggctgcgcgccgtaccggccggccgatggatccgggcggacagctcgcgtgccgagcgggcccgctgggccgcctccgaccgccactcaccgatcagaaaccgcacgtcgtccatgtcgtacgcgtcattcatcgcgtgcctccctcgccgcggccggttcgcgccgcaaacgctagcgacgatcccgagatcacggagaggcctgtggacaacctcggtcagcccgggtcgacggtgtcccaggagtagtcgaagccgtccggcgggagccgccattcgcgcagcacagtgaggagttcggactcgtcggcggcctgcgcgcagcgcagccggacggcgcccggcgggtcgtaaccctccagccggtccgcttcgtactcccactgcgtgaccaggaagctgcggccggtgtcactgcgcgccgcgcccgcgcgaagggcgtcctcgtccgcggaacggccgctcggaacgatgtgcacgaacgaccagcgatgcggctgcgaggccgggaccagcatcgccagccggcggccgagtcgcaaggccgccagcttcggagccggccagtgccattcacgatgatccatgacagcccgcagcgtacccaggaaaggtttcgacaatgcatgccggcccgccgcgggacggatcgacaccctttcgagggatcccgggcgcggcgtgccgcggcgcccggcagaccattccggcgcgcgatccgcggtccgctcccgcgccgccgaagatgtccgccgtacggccatttccgctgccccgagggccgatgcagtttcggtatggccgaatgtccgcccgccacgcgagacgaaccgttcccgcgtgcacccccaccgccccaggcaccggctcccacaggggccacccgcgtccccgcgaagtgctcagcgccgcccgtccgcccaggcagcggccgatgccaccggtccggccggcgtcggcaccgacgggcggcagccggccgagcgctgtccacaccccggattttcggtcggccgatcgcgctaccgtgcccgggtgagttacatcagcccggccgaggaggccgccaccgtgatcgccgcggtgctccgggatctgcggtcccaccggcaccggggcgtcgtcgtcgactcgccgcccggcgccggcaagtcgactctggtggtgcgcgcggccggggagctggccgccaccggcgagcccctgatgatcgtcgcgcagaccaacgagcaggtcgacgacctgatcgagcggctgggtgcgcgctcccccgacatcaccgtcggccgcctctccgcggtcgactacgagcgctccgaccgggtcaaggagcatccgcactgccgtgtcgcggccaaggtggccgacctggccggtcctgcggtcaccatcggcacggcggccaagtgggccaccgtcgccgagggcagctggccgtgggcgatcgtcgacgaggcctatcagatgcggtccgacgcgctgctccgggtcgcgccccggttcgagcgggcgctgttcgtgggcgaccccggccagctcgacccgttctccactgtcgaggtcgagcgctggaccgggctgtcctgggatccgatgcagagcgccgtcgcggtgctgctgcgacacaaccccgagttgccggtgcaccgactgccggtctcctggcggctgccggcgtccgccgcgccggtggtggccgaggcgttctatccgttcaccggtttccgctccggcaccggcccgggcgaccgcaccctgcatttcgaggcgcccggcgagactccgctggaccaggtgctggacaccgcggcgaaaagcggctggggcctgcacgagctgcccgcccggttcaccctgcgcaccgacgcggaggcggcggcggcctgcgcccagctcgccgcccgggcgctcgcccgtggcggcgtcaccgagtccgaggccgggtcgggtccgctcaccccgggtcggatcgcgatcggcgccgcgcaccgcgaccaggccgcggcgatccgcgcactgctgcccccggaggcggccggcatcaccgtcgacacggcgaaccggctccagggccgggagtacgacctcaccgtggtcctgcatccactgtccggccggcgggacgccaccgccttccacctggaatccgggcggctctgcgtgctgacctcccgacatcggcacgcctgcgtggtggtggcccgggccggcatcccggagctgctcgacgcgcacccgtccaccgagccggtgcacctgaacgttccggtcaagttccccgatggatgggaggcgaatcaatcgatgctggcgcatttgtaccgtcggtaaaccaccggcgaccgtcgatgcgactaccttgagggtatgacgcccaacggggcttatcgaccgattctccggccacgtcgcggcgagttcacggcgctggcacacctgtccgcggacgaggctgcccggatcacgccgatcgtcgagttggatcccgaagtcagcatcatcccgctgctccgggaactacgaccacggaccggggaactggcgctcgacttcgggcacgtgccggagccgacggcgaccgcggagcagccactcgccctggcggagcgactgttccggctcggggtggccacggtgccggtgctgcggccgtacgaaagcggtcgtcgcctggtgtcgcacggcctggccgcgcggatgcaccggcggcgcgcggtcctgcggatccaaccgcacgtcgacgcggggaatccggcccgggccgacgcgatcgccgaccgggtgctggccatcaccgcactcgacccgaacgaggtcgacctgctgatcgacctggccgagacgccctgcctggcgcacgccgacgaggtcgaggaacgggcccgccgggtgctgcgctgggcccggttgatgccgtggcggtcggttagcgtgggttccggtgcgatgccgcccaacctggacgacctgcccaccgaccggccggtggcggtcggtcgactggacgcccgggtatgggaacggctcggcgaccccggggtgggctacgcggactacggggtcacctcaccggtgcgccggctcggcgtgcagcatcaccggcagttgccgacgttgcggtacaccaccgagtcggactggtggatctaccggtgggcacggcgcggcggccgcagcgacgaccgctgccacgacctgtgccgcaccctggtcacctcaccgcagtggccatccgcgggcgcccgattttcgtggggcgacgccgagatcgcccgccgcgcccgcaccgcgcgcggggcgggcagctcggcgagctggatcgcctggagcacgtcccaccacatctcccacgtcctacgcaccctccccacgggctgacccgccaccgacgccacgcgctttcccccgaagcaacgtcggcatcctcagccgcgccgcgccgcgccgcggccggccgggcgaggcggctagctagctagcgcgaacacgcggcggacacgggtgcgaggccggtaggaccgggtcgggcaggggtggcggcggaccgaaagcaggccgcagggcgaaagaaccggggcgaggcgggatcagccggtgagccggaccagcaggagggctatgtcatcggtgcggcgcggggcgacctccagcagccgggcgcacagttcgtccccggggaaggcggagctttcccgcagccgttcggccaggcgggcgacgccgtcgtcgaggagctggtcgcggtcctcgaccaggccgtcggtgtacaggaccagggtggagccgggcggcacgtaacggatggtggtggtgcggtcgctgggaacggggagaccgagcagtggttccggcgggacccaccacacctgtacccggccgtcgggcagcaggagcagcggtggcgggtggccggcgttggcgaagctgatcgcgtacccggaccaggactggcggacccgggccagcacggcggtggcggcggccggcacgcgcaggccgtgcagggcctggtcgagctgggtgagcagggcgcccggctcgtcagggcggccgtaggcgtcgccgcggaccaggttgcgcagctggcccatggtggcggcggcttcgatgtcgtggccggagacgtcgccgaccgcgaccatcacgctgccatccggctgggcgaacgcgtcataccagtcgccgccgaccgcggcgccgtcctgggcgggcaggtaccgggcgtgcagttcgacgccgggcaggtcgggcagctcggtgagcaggctgcgctgcaggacctcggcgacgtggcgctgctcgcggtacagccggctgttctcgacggccagcccggcgcggcggccgatctcggcggcgacgcgttcgtcggcggcggtgaacggggcctggtcgggaccgttgaccagcaggacggagccgacgacgcggcggcggaccggggagatgatcggggccacgaccgacgagccgaggccggcgacggtggcgagctcggcgatctcggtgtcgctgaccttgccgcggagcaggtcggtgccttcggcgcggcggggtgggcggcgggccgcggtcgccagggtgcgcaggtcggtgcgggaccgggcggtcagctcggcgagccgggacatgtcggcgttccgggtcgggtcgcgatgggcggcgacgacccgcggctggtcaccataggtgatcacacaccagtcggcgagccgggccgtgacgaggctcccgaggcggtgcatcgcctcgtccaggtccatggtggcggccagtgactcggtcaggtcggtgagcagctccaactggtggtgcgcggactcggcggcgcgccgggcgtcctcggcggcggcccgggcgatccgcaggcagacctccgacgaacagaccgcagccagctcggtgagcagggtgatctcactctgcgtccaattccggggttcgtggtcggccgcgcacagggcgccgacgaccaggccgtccgggtcggtgatcggggcgccggcgaaggcgatcgcacccagctgctcgatcgacgggttgccgcgggtgcgcaggtcgacgcggacatcggggatgaccacgaggcggccgttgacgacgacgtgccggctgaacgagtgggtcagcggcatgctgcgcccgctggcgaacggctccggcatgccgacctgcccggccagatgctgacgctcggcgccgaccaggctgaccactccgagcggcgcgtcgacgagcttgcggaccagcatcgcgacccggtcgaacgcctcgtcgggcccgggctcaccgagccgccgcaccgaacgcaggcgcaccggatcggcgagcacactctgctcggtgtcgccgatgacgtcccactgcagcaccatcgccccccggccggttcgcctgccaggctaccggcgcgaggcccgccggcgccgtcgtgcacccgacccgatcatccgtttccggtcacccgatcggtcgacagagcggccgatcatccggaaggcgacccctttcaggatcaactgcaggatcgccatgcagacgtcgtacgcagcgggcggtcggtggatcgccgcgggtcagatgggcacctcgacggtgggtggaccgccgtgggtccacggcgtttcggacggatcaggcagcgcgccgccccggcggaactcctcgctgagggtggtcaggatgagccgctcgccgaccaccggcacactgcccggctcggccaccagcttgcgccccatccccccggacagctccagcagcacgtcgaactccggcccgaccgccgtcaccgagatcacccgggccttctgggacggccgcgccggtgaggtcagcgacgtgcccgccgccacccggaccggctccccggtccgcaccatgatccgcggccgcagcaccggccgtttcccgctgtcgtcgatccgatccggcgcggccagcgtcaccaccccggcgaacgcggccccggccagccggtactccgccagcaccagcggatcgtcgaaggcccgctgcaccgcgtaccgggacgccgccgtctccagccgctgcagccgggcggccgccgcgaccgcgccgtcccgccggggctgcggcgccccgccctcggccaggtgctgcgcgaacgcggtgtacgcgtccttgtccgcgtcccaccgcagcccgacccgctcccccaccggcagccggcgcagcaggttcggcacccgccacatccgttcccaggtgggcgtcatcaggtcacggagcacgtcggacatctccggcgcgcgtcgctcgatcagtggcgccagcacccggttgtcgaagtccgggtcggtggccggcccggcgatcggcccgttctcgaccgcccgggccgccgcggcgccctcctcgatccacgccatcagcaccgcgagttgcgcgtcctcggtgccgctctgcccggtcgcccagtgcagcccgagcgcctgcacggcgttgaccagcagcgccgacccgggcacttcggcgctgttggcgaagaaggtgagccaccgaccgagcagcggcacggtggccggcaccgggtgttcgccgtcgacggtgcggaaccgggtggagcgcccgaacaggcgcaggaagtcgacgccggccgggttcggcacccagatctggggcgcgtcggcgtaccgggtgcgcacgtccttgccccggtcgacgggcacgtcctcggtcacgtcggcgaaggaatcgacgtacgccgcaatgatctgaccgagacggtcggcgaaccggaaccgctcgtcgcggtcgcgcggctggctgaccaccaggagttccggcgtagccgggtcggtgccgaccagggcggccagcggcgcgttggcttcgccggccatcgcgagcgggatcagcaccagcggatgctcgtggacgtgcaggtgccgcacggtggcgatgggctgggcgcgcccggcggcgaccgcctgtgcccgggcgagcgcggtgagcgtactcaagaaagggcttcttcgcggagccggagggcggcccgcaggagggcggccgcctcctcctgctccgcggtgggcgcctgcgcgccggaggcgagcgccagcacctcgccgatggtctcgaccccgccgagcgcctcgcgcaccggccggccgagcgccgccgtcgtcccgttcgcctcgtgccgacagtagacggagagttcgcaggtggacaggcattccggggcgtagcgcggggcgatgtgcccgagggcgacggtgagttccgcggcgggtcgttcgaggtcgaaggtcagcccgggcggcaatgcctcgacgagcgcgccgaccgacgccatccgggccagctggcggcgcagcgtggacagctgtttgcggacgtcgagccgcaccgggaccgggcgcatcgcgaagttctccgggcagaccaggaccacctcgtgatcgacgagctgggggtccatcccgagccggccgagcagctcgcgcagcgcgagcacgtagaccgcggcctgggtggccgccccggacaccttggcgctgtccgcctgcccgtcgatgatcgcgaacgacttgatctcgaccacctgcagccggccctcgtgcgcgtaggcgaccaggtcgggttccaggtagacggtctgcccggccacctcgagggtgagcatcgggtggtcgatcagcgcggcctcggcggtggacagcagcgtggcggtccgggcgtgccggtcgccgagcgtgtcgtcggtgtcggggccgaggtcctgatacggcgacgccgaggaggcgccgagcaccgtgcgcagcagggcgcagtcgtcggccttgagcatcgcctcgaacgcgttgccccgggacagcgcgaaccgggactggccgaagctgcccgggaagccgaccgtctcggccagtttcagcttgtcgaccccggccgcgtcgaggacggcccgccggttgcagccggggttgccggtgagcgcggcgatcgtgcgcgcgttgtgccgcttcgccttaccggagccgcgcagctcgtcaagccgggtcatcagcgcccttcttgatcgacagatcaggggaagtctacggcaggacggcaatccggccgcggttcacccgcgagaggtgaataaaacgcacatatcagtcacaaatccggcggcgcgctaggttcggagcatgccgaaggccatctggaacgacgaagtgatcgcggagagcgacgacaccgtggtgctcgaggggaactattacttcccgctcacctcggtccgtgaggacgtgctcatcccctccgacacgcacaccgtctgcccgtggaagggcaaggcgtcgtactactcgctgcgcgccgacggacggaccgccgccgacgccgcctggtactaccccgatccgaaaccggacgccgcggccgtccgggaccgcgtcgccttccgcaaagacgtgcaggtggagatctagacccgcccccgggggcccactcacgcgatgcgcgggtgggcctcctcgatcgcggacacctccaggtagtccagcatgtcccgctgctcggcgggatccagcgcccggaaggcggcatacgcctcggcccgggcgttctcggtctccgcggccagcagcgcgatgatcgccgaccaggccagcgacacccggtcgaacaggcgcgcccgacgcagcgaggtgagccgggtcagcatcgccaccttcgccaccgcgtcgtcgtcaccggccagccggtcacagagctcgaaaagcgccttgccccggtacgggtgctcggcctcgaccatccgggccagctcggcgttgtccatctggtcgaccgccggggccggaccgcggcgcggcaggcggggactcggctcagcgtgcacgactgtcccgcccaccctcgtagccgttgcccggcgactgatgcggcaacgtcggcacggcgctgaacgacgggaacggcggcgccgacggcatcaccggggccggcggcacctcgtccggagccgggaaccgggacgcgaaaccgtccagcacggcacgacccgtctcggtctccgcgcccaccgtcgacgcgaccgcctcggccacccggccggccagcgccgcctgcgcccggtgaatggtcaacaggatctcggcggccagccccggcgcgcccagacccagcgaccgctcgtccagctccagcccggtcacgttacccgaactcgccacggtgacccgcaccgcaccgccggccccggccgccgacgcacgcagcgtcgccacccggtcggccagcgcggcggccgcacccccggagcgggatgcgccgtcaccgacgcccagctctccacccagcacgattcgccctccgttaccgacttgcggcagtgacgtcccatgagatcacggccgcgccatccccgcgagcacccacggtagcgactcccggcgctcacccgacccggcgaccgccgtaaccttcaagcaacgcatcgaccgccacgatcgagggggtgccgtgggaagtgttcagccggacgacggacacgcgccggagtggcactccgcgatgatcgacgtctccgaatcctccctggccgagctcgtcgtccgcgacgattccgccctggaccgctgcctgcgccggctggccgccacccgatccgggccgagcgaacagatcgccggcttcaactcggcgctctgaccaccaggatcccgttgcgccagttccgcctcgccgacgccgccctcgccgacctcggcgccggacggccgtcccccgccaccctcggcctgctgcgccgagcgcagctcagccgcaatctgctcctcctgcggcagctgcggcgatctgtcaccgaaaagccgatctggtacgcgcgactggccgccctgtcgccccaggacgcccgcacccgcatcgtcgatccgatgaccggcctgtgggccgcccacgccctcaccacacccccacacggcctggacgcgccgctggagccggtcgggcacctactcacggtcacctgcgccgggcgggaattgaccgtgcggctggacgaccggagtcccctgcggcacctgctcggcctgccaccggccgacccgttgaccgccgccgaggtcactcactggcaggagtgcctcgaagcggcatggcggattctggtcacccggcacccggccgccgcggacaccctcgccgccgtgctgcgggtgatcgtcccggcccgtcctgatccactcgccgaaggcgtgagcgcgacgtcggccgaggcgttcggcgcggtcgccatgtccaccccgatcaccggcaccgggatggccctggccctgctgcacgagacccagcacagcgtgctgaacgcggtgaacggcctcttcgacctggtcgaacccggcggcgcacccggctactcgccgtggcgggaggacccacgcccggcgtccgggattctgcacggggtctatgcgttcctggcggtgacccgcttctggcgcaccgcgatccgcgcgggtggggctccggccggcagcgaggcggagttcgagttcgcccgctggcgcaccgcggtccacgaaaccgccggccgcctcctacgcgccggcgagccgacgacgggcatagcacggcaggctgccggcgagccgacgacgggcacagcaccgcaggctgccggcgagccgatcaccggcgaagcacgaccggctgccggcgagccgaccgcggtcgggacccgaccggctgccggcgagctgaccgcggcggggcggcggctggtcggtgcgttgcgggacgaggtggagccgtggctggcggagccgctcgaccccgaggtgacccggctcgccgacctggcccggaccgatcatcacgcgcgctggcgtctgcggaacctcgctattccggcagagggactgaaagcgctcgtcagcgcgtgggcggcggaacgtcccgcaccggccgtcgagtccacggtggccgaacgaccgcgacgggaggagccccaccaccggctgcgactgatccgggcccggctgcgaggggatcaccggttcccggcggaggcgcgggagaccacgacagcggccgcggacgacgcctgcctggatgggcgatggcaggacgcgctcacggcgtacgcaacaattcttggccaggaccgcgacgacgccgcggcctggagcgggctcgccctcgtctcgccgctgcccgccctgcgccgctagctagctagacatcgcggcgctcgccgcccggctctaccgccgacccgacgccgccggccgggacgtgcccggaccgcccggatccggactcgcccgggacggtgcacgtgcagacgaaccggtcggttgcagcacggtgagctgcggcttcgtagccggttgcgaagcccgaaacgcgacccggatcacttaacccacccgccgccgagacgatgtgagcggccggaggtgggtcgtggctcgcaaggctctgttggaccggacgcggcgcgtcgtcgacgacggcgtggtgctcgcttcgctgctgctgctggtgtggccggcagcggacgctacggatgtgacgttgacgggtcggctggtgccgctggccgcggccctctgtctggggctggccatgctgctggtggcgccggaccggccggtgctgcggttcgccccgacggcggcggcgctcgcggtcagcgggatccggcacgtgcagggggagctcgccccgggagcggtgtggctgctgctgggcatggccgtggcggtgctgttccgccgctgggcggtggccggctcggacaacgcgctgatccgggagatgacttcccagcgggcgctgctggcccggcaggcgtaccgggatccgctgaccggggtcggcaaccgcaagatgttcctggagcgggccgatcatgagttgtccgcggccagccggacgatgaccgcggtgatcgtggtggacctggacggtttccgggagctgaacgacgagttcgggcacgaggtcggcgacggtctgttgcgggccgcggcggaccggctggccgcgaacgtccgggccaacgacgtggtggcccgcctcgacggcgacgagttcgtggtgctgctccccggggtggaggacgagcaggccgccgtcgcggtggccgagcgggtgctgaccgagctgcaccggccgctggaggtggacggcatcaagctgaccgtacgggccagcgccggggtggcgatcacggccggcggcgagaccatcgaccatgtgctgcgcgaggccgatcaggcgctgcaccgggcgaagctggacggcggcggcgcggcccggcggttcgacccggcgctgttcgccctggaggagcagcgtcgcaaggccgagggtgacatcatccgggcgttggacctgggcgagttcgaggtgcactaccagccgatcgtcgacctggacggggagcacacggtcggtgtcgaggcgctgatccgctggcagcacccggagaaggggctggtgccgcccgggctgttcctggagctggccgagcagctgggtctgctgccgcggctgggcggctgggtgctggaggaggcctgccggcaggcggtcaactggcagcggcagttcccgggtttcgagatgaacgtgaacctgtccgcctcgcagctgagcaacccgaatctggtcggcgaggtccgcgcggtgctggagcgcaccggtctggagccggagcacctggtgctggagctgaccgagtcggtggcactggtggacctggtcgagtcggcgcggatcctgaccgagctgaaggagctgggggtgcggatcgcgctggacgacttcggcaccgggttctcctcgctcagccacctgagcgcgctgccggtggacgtggtgaagatcgaccggtcgttcgtgcaggcgatgccggagagcggcggggcgtcggtggccgaggcggtgctgcacatcgcccgcaccttcaacctggcgccggtggccgagggggtggaggacgcggcccaggcggagtggctgcgggacctggcgtgcggccgggcccagggttaccacttcgcccgcccgatgccggccctgggcgtcaccgagctcctcgacaagcaggccgacaaggacgtcccgctcgcctcctgagctacaacggcggcaggtcgatgtccgtctccaggcgttgcccggcggcggtcacccggaagatcgggtggccgtcgccgtacgctttggccagcccggtcagcgcctgctgctgtgccgtctcgtcggcgtcggcgagggcgaggttccacgcgcaggccaccgtgtccgggtggtcggcgccgcgcaccacccgggaccggcgcagcgtgtcggcggccagttcccgggcctgctgcgcctcgccggccgcgaacaggtccccggccaggccgttggcgcagctgagcgtgaacggatggtcggcaccgacgctgcgccgcaggccgccgagcacctcctcgtcgatggtccgcgcctcggcgtaccggccggccgcccgcaccaccccggccagcccggcggaggcggcgagggtgaacggatgttcgtcgccgagcaccgcgtggaaccggatcaccgcgcgttccagtagttcgtgggcaccggccaggtcgccggccgcgcgcacgcagttggccagcgacaccgcggtggccagggtgtcgacgttgaggtcgccgaatcggcgacggcaggcggccaggttctcggtcgccatctcgcgggccgcggcgacgccccggcggtgcgcggccatcgcggtgagccggccggcccagagcgcgaacgggtggtcttcggcgacctgttcggcctgcccggccagcaccgtgccgaccccggcgtagtcgccgaggccgaacaggtcgtaggcgagcgccgcccgggacgccagggtttccgggtgcccgtcgacgaagatggcatgccgatgccgcagggtctgctcgtcgagcgcccgggcgccccggaagtcgccgagcagccgcaggtcgatggcgaggttgttggcgcagcgcagcgcggtcgggaagctctccccgaacagtcggcggtagcggaccaggttgtccgcgtcgagctgccgcgcctgcccgaagtgtccctgcattcgcaggtcgccgccgacgctgttggcggtcgccagggtcgcctcgtcgtcggcgccgaacacctcccgctgggtgcgcagcgtctgcaggttcagcgcccgcgcgtcggccggccgacccaccgcgcgcaacgcgttcgccaggtggaaggaggcgagcagggtctgctcggcggattcgccgagggcgtcgcgccagcgggccaccgccgagccggcgagttcccggctggagtcgtagtcgccgcgcgcgtagtggaaccggatgcagttgatcaccagctggcggacctcctcggcgtcaccgcccagcaggtcggagtggatcaggtggggggccagctcggcgtaccggtaccagccggccgggttgtccgggtcgccggggtcggccgcggacagcatcgcgcggaccgtgcgcagcagctcggcgtgccgctcggagctcagttcctggccgaacatgccgcggatcagcgggtgcacggtgagccgttccccggacggatccagcccggccagcccgaaccgggcgatccgccgcatcgccgcgcgcagccggcgctcgacccggacggtgcgggccacctccgggtccagcgggcaggtgcgggccgcccagagcagctgccaggagatcggcgcgctggccaggaaggtgcacagctccagcagcacccggtcggccggggacgcctcgcccagcgcgtcggcggccaggccccaggtcacccggatcggggtggggaaggcgagttcggcggcccgacgctcgtaccgctccaggtattcggcgaccggccagccggtggccgtgcgtaccgcggcggccaggtccagcgcgatcggcacgtcgccgagccgggccgcgagccgatcggcgtcctccggagacagctccggggcacggccgcgcagcaggtcggtggcgtcggcccggtccagcaccgggaccggcagggcctgcgccacctcggccgtccagcgcgggttgcggctggtcaccagcacgtggccggcgccggagggcaggtacggcatgatgtcctcgggccggttcgcgttctcgaagacgaccagccagtgccggaacggctcgccccggctcagcgcgtcccggacggcgccgagggtgcggttgagatcgcgggtttccggcagtcccagtttccgggcgagcccggccagcgcggcgcgcatcccggcgccctgctcggccgggatccaccagaccagctcgtacgagtccgcgtggcgataggcatattcgatcgccaattgggtacgtcctgtcccgccgagttgatggtcgggactcggcagcagcaccaccggaccgttgccgagcaggccgcgcacgcgggtcaggagttcctcacggcccacgaaacggggattgcgcggcggcagaccgccacggatcggcacaccgtgctcctcacattttggtgatgccgattaccgtacgtggaacccccgcaacagcaaagcgggcacgcgcccgcgagacggaaggcccccggtgatcgaagaagtgacgagcctggatgccgacggcaacacgaccaccgtttcgctgcgcggtgagatcgacgtgctgaccgtggagcaggtccgggtcgctctgggcgaggcggtcaccggccgcccgcggcagatcgtggtggacatggccgcggtcgcgttcatcgactcgaccggcctcggcgcgctgatctccggcttccagcgggcccgtgaccagggcatcgccttccagctcgcgcacccgagccccaacgtccgtcagattctggtgctcagcgggttcctggaggtcgttcaggtcaccccgtgaaaacccgattgcggtggtacgacgcggggccgtcccggcccggggaggcggccgcgccaccggattccaatggcgcggcgggcggtgcccacggcgtacgccgccatcgtgtctcaggccttggcggcgggaacggcgaggccgaggccgggggcgagtggcttgaggtgtttgccggcgaagagcatcaggctgagcagggacgccaggagggcgagggcgcccgcgccgtaccaggcccaggtgtacgcgccgagctggtcgcggaccaggccggcggtggtggcggcgatcgccgcgccgatctggtgggaggcgaagacccagccgaagacgaccgggccggcggcgccgaagtactcccggcacagggtgaccgtgggcgggacggtggcgacccagtcgaggccgtagaacaggatgaagaccagcatgccggggtgcgcggtggcggccaggatcgacggcagcacgagcagcgacaggccgcgcagggcgtagtaggcgccgagcaggacgcggctgtcgacccggtcggtgagccagccggacgcgatcgtgcccaccacgtcgaagacgccgaccagggcgagcaggctcgcggccgtggtgttcggcatgccgtggtcgtgggcggccgggatgaaatgtgttccgaccagcccgttggtggtcgccccgcagatcgcgaagccgccggcgagcagccagaacgcgcgggtccggccggcgtcgcggagggcggtgagcgcggtccggacggcgttgcccgcgggcggggcgggcggttcggtgatgccgccgagcgcggtcgtcccgagatcctgcgggtggtcccgcagccgccccaggatcaacggtacgaccagcagcgcgatcgccgacacggtgagggccgcggtgcgccagccgtgcgactcgacgagccgggacagcaccggcaggaagatcaggttgccggtcgccccgccggccgtgaggatgccggtgaccaggccgcgatgtctgacgaaccagcggccggtgatggtggcgacgaacccgagggcgagtgagccggtgccgaggccgaccagcacgccccagcagagcatcagctgccagctgtggtgcatcagcacggtcagcccggagccgagcgcgaccaggccgagcgcggcggcggcgacccggcggatgccgaaccgggccatcagggcggcggcgaacggtgcggtcagaccgtagagcatcaggttgaccgagacggcggccgagatggtgcccagcgaccagccgaactcggcgtgcagcggctgcagcatgacggacggggtggagcggaagccggccgcgccgatcagggcgatgaacgcgacggcggcgaccgaccaggcggggtggaggcgtgctttcacgccgttgattcttccggggtccggatgatcggacgagtggcccgaaggccatcatgcgcaagaatcgagccatgccccacgtgatcgcggtcctggtcctcgacggtgtcgtcccgttcgatctcggcgtgcccgcgcaggtcttcggcgcggcccgggacggcgcccgcaaccggttctacgagctgctgttctgcggcgaggggccggtccgggccgaggccggtttcaccgtcacccccgaccacgacctgagcgtcgtggcccgcgccgacaccgtgctgatccccggcatccacctcggcggcccggtcaccgacggcagcctgcccgacgcggttcgggaggtgctgctggcggcggcccggcgcggcgcccggatcgtgtcgatctgcaccggcgcctcggtgctggccgccgccgggctgctggacggtcgcccggccgccacccactgggcctgggccagccggatcggtggcctgtatccgcgggtcgactgggacttcgacgtgctgttcgtggacgacggcgacgtgctcacctcggccggggtcggcgccggggtcgacctctgcctgcacatcgtgcgctccgatcacggcgccgaggtggcgaaccgggcggcccgccgctgcgtggtgccgccgtggcgggacggtggccaggcgcagtacatcgagcgcccggttccggccgccgcgaacagcggcaccgaaccgacccggacctgggtgctggaccggctggccgacccggtcaccctggaggagatggccgcgcacgcccggatgagcgtgcgcaccttcacccggcggttccgcgacgagaccggctccagcccgcggcggtggctgctgcgccagcgggtcgagcacgcccggctgctgctggagtcgaccgacctcggggtggacgtggtggcccgccgggccgggctgggcagtgccacggccctgcggcagcacctgcacgcgacgatcggcgtggccccgtccgcgtatcgacggacatttcgccactaagttttctcccgggatgtccgatggaggggtgtataccctgtgccgcgcctgaggactccatggaccaaaccttccgcccgctgctcgatgccctgaagcagatcggggtcgacccgcacgcggtcgactcggctgccgaggaggcccagcgcagcgggcgtccggtgcgggccgtcctgatcaacgaccaggtggtcaccgaggagcagctgacccaggcggccgccgcggcgttcgggatcaacaccctcgacctggtcggcttcaccccggacccgaccgcgctgaagcgcatcccgctgcccgtggtgctccggcaccgggtgctgggcctggcgatcaacgacggcgagctggtggtcggggtgaccgacccggccgacgtggtggcgctcgacgacgtacgcgcggcgaccggcatgacggtgcgccccgtggtggtggcccgctccgaggtccgtcgaatcatcgagaagctgcagcgcgacgacagcgacctgggtgacctggccggcgccgggatggacgactcggccgggatggccgcgcagcagaccagcaccgaggacgccccgatcgtccggtacgtgaacagcctgatcgagcaggccgtcatgaaccgcgcctcggacctgcacctggagccgaccgaggacgagatgcgggtgcggtaccggatcgacggcgtgctgcacgaggtggacatcgtgccgcgcggcgtgatggcggcgctgacctcacgtatcaagatcatgtcgggcgtcgacatcaccgagaagcgggtgccgcagaacggccggatcaccgcactgatccgggaccgcacggtcgatctgcgcaccgccaccctgcccacggtctggggcgagaagatcgtgctccgcgtgctcgacaccggtggcatcgacctggatctgcgcaaactcggcttcaccgagcacaacctgagccggttcgaggcgtcgttcaccaaaccgcacggcatggtcctggtcaccggcccgaccgggtccggcaagtcgaccacgctgtacgccacgctgggccggatcagcaagcccgaggtcaacgtgatcaccatcgaggacccggtcgagtaccgcctgcgcgggatcaaccaggtgcaggtgaacgtcaaggccgggctgaccttcgccgcggtgctgccggccatcctgcgctccgacccggacgtggtgctgatcggtgagatccgcgacggcaccaccgcgcagatcgccgtcgaggccgccctcaccggtcacctgctgctctccacgctgcacaccaacgacgcgccgggcgcggtcacccggctcaccgagatgggcatcgagccgttcctggtcggctcgtcgctggactgcgtgctggcccagcggctggcccggcggctctgcgactggtgcaaggaggcgtacgcgccgaccgaggaggaggtgctgggcgctcgctggccgctggaggacctcgccttcccgcaggtgctctaccgcccggtgggctgccgcaactgcgcgaacaccgggtacaagggccggatcgcgctgcacgaggtgatgccggtcagtccggagatcgagtcgctgaccatccgccgggcaccggccggtgagctgcgcgaggtggcgctcgcccaggggatgtacgacctgcggtcggacggtctggccaaggccgcgggcggtctgacctcgattcgggaagtttcccgggtcgctgtctgaaacacccgattcgctactaaagcccgtcccagcggtgccgattcaacaaacgtcggaacgcgaacgaaagggccggagcggtgaacacgatcgagcacgggacgcggcagccggagacggcggtcaaccccgacgacctcgccgtgctcgaccagatgttgatcaccctggtcgagtcgcgcggctcggacctgcacctgacggtgggctcgccgccgatgatgcgggtggacggatcgctgcgggcggttccgggttacggcaagctcaacgccgcggacaccgaactgctggcccgcgcggcggtcaccccggcgcagtggcagacgttccaggccgagcaggagatggacttcgcgcacagcatcgtcggcgtctcccggttccgcggcaacctctaccggcagcgcacctcgtgcggcgcggtcttccgggccatcccgcacaagatcaagccgctggacgagctgggcatgccggagtcggtggcccgtttcgcccacctgccgcgcggcctggtgctggtgaccggcccgaccgggtcgggcaagaccaccaccctggcctcgctgctcgacctggcgaaccgcagccgcgccgaccacatcatcaccatcgaggacccgatcgagttcctccacccgcacaagcgcagcatcgtcaaccagcgcgaggtgggtgccgacaccgacaccttcgccagcgcgctcaagcacgcgctgcgccaggacccggacatcatcctggtcggcgagctgcgcgacctgaccaccacggcgacggcgctgaccgccgccgagaccggtcacctggtgatggcgacgctgcacacgcagagcgccacccagaccatcgaccgggtcatcgacatcttcccaccgcaccagcagttgcagatccgcgcgcagctggcggccagtctccagggtgtgatcacccaggcgctggcgccccgcgcggacggcaagggccgggcggtgatctgcgagatcctgagcgcgacgccggccatccggagcctgatccgggagggcaagtcgcaccagatcccctcgttcatgcaggccggcagcaacgagggaatgctcgccttcgaccagcatctggccgaaaaggtgcgggagggcatcatcaccatgcagacggccaccgagatcagccactcgccggaagagctcaagcggcttgtcgggaggtcctgaccatgagcggcacgaacaagacgttcgcctacagcaccatcgacgcctcgggcaagaagtccaagggcaccatcgaggctcccaacgaggcggccgccacgcacatgctccagcagcggggcgaggtgccgctgggcctggtcgaggccggccagggtctgcagcgcgagctgaagatccccgggctgggcaaccgggtcaagctcaaggacctggcggtcttcgcccggcagttcgccaccatgacctcgtccggcatgtcgctgctgcgctctctgtcgatcatggaggagcagacctcgtcgccgccgctgaagaaggcgatcggtgaggtgcgctcggacgtggccgccggtggcgggctgtcggcgtcgatggccaagcacgaccgggtcttcccgcgactgatggtcgcgatgatccgggccggcgagacgggcggcatgatcgaccgggcgttggagcagatcgccgacagcctggagaaggacaccgcgctccgcggcaagatcaaaagtgcgctgacctatccggcgatcgtgctcggcttcacgttcctgctgatcgcggcgatgctgatcttcatcgtcccgatcttcgaggcgatgttcaagaacctcggcggcgaactcccggcgatcacccagttcctcgtcacgaccagccacaacatgtggtggatcgggccgctggtgctgggcatcgggatcggggcggccgcggcgtacaagcaccagcaccggaccagcgccgagttccgcctcaaggtcgacaagctcaagctgcgcatgccggtcttcggctcgctgttccagaagctggcgatgagccggttctcccggaacctcggcctgctgctcaacgtcggcgtgccggtcatgcaggcgctcgccgtggtcggcgagaccaccggcaacgaagtgatcaacattgccatgcaggacatccaggcgacggtccgcgacggccagccgatgtccggtgcgatgcgcaaccacaaggtcttccccgagatggtcaaccagatgatcgaggtcggggaagagagcggccagatcagtcagatgctcgacaaggttgccgacttctacgacagagaggtcgacgccgcggccgagtcactggccgcgtcgatcgaaccgatcatggtgctcgtcatgggcgcggtggtcggcggcatggtggtctgtctctacctgccgatgttcaccatttaccagaacattcagtccagctgattctcagcacggccgcttcccgacggccggcaccacccgggcacccgagctcggttctcccttccccgctccacccgccccttgccaggaaaggcaccccaaatgcagaacgtcatcgaccgaatgatcgccaagcaggccgagatccgcgccaagaaggacgacgagggcttcaccctcatcgagctcctggtcgtcgtggtcatcatcggtgtcctcgtcgcgatcgccgtgccggtgtacctgaactaccgccagggcgcggccgacaagtcggcgcagtcggacgtccgcggcgcgatcagcgcggtggagcagtactacaccggcaacggcaacacctacccgacgaacgcggcgaccagcatcgtggccaacagcacgccggccagctcgatcacgctcccggcgcagaccggcggcacggccggcaccatcaccgtgtcggacaagaccgagctgacctacgtcccgccgtccggcacgtccagctacaagatctgtgccaagaacaccggcggcagcggcaaggtctacctgtacgacgcctcggtcggtggctcggtcaagaccgcctcgggcatcacccccaccgcgaccggctgctgacccggcaccaccccgcatgacgggtaacgggtggcgtcaccgtcgtcggtggcgccacccggccgctcgttcgcttagttcgcctcgttcgcccgttcgcctcgttcgcctcgttcgcccgcttcgttcgctcgttcgtcgagaggagcccgccatgccactgagccccctgctgctcgtcgtcggccttctcggcctcgcggtcggctccttcctgaacgtggtgatccaccgggtgccccgcgacgagtcgctggtacaccccggctcgcactgcccgaactgcggccacgccgtgcgcaaccggcacaacgtcccggtgctcggctggctgatgctgcgcggccggtgcgccgactgcgccaccccgatcagcgcccgctacccgctcgtcgaagccggcaccgccgccctgttcgtcgcggtggccgcccggttcggctggtcctgggccctgcccggctatctctacctggccgcggtcgcgatcgccctggcgctgatcgacctcgacgtgatgcggcttccggacaagatcgtcttgccgtcgtacgcggtggctgccgccctgctgatcccacccgccctgctggccggtgacccgaccgccctgctccggggcgccgccgctgcgggtctgctctacgtgctctaccgggtgctggccaccttcggcatgggccggggggacgtgaagctggccccgctgctcggcttccacctcggctggctcggctggggcgcggtggcggtcggcgcgttcgccgccttcctgctcggcggggtggtcggcgcgatcctgctcgccacccgggtcgccgggcgcaagagtcgcatcccgttcggcccctacatgctggccggtgcgttcctcgcggtgttcgccgcggccccgatcgcggaatggtacgcccagctcctcatccccgcgtcgttctgaccgatcagccgggagaaccccaccgcaggaaaggaagaccgatggctggcgcaacaccgatcgggctggacatcggctcgtcctcgatccgggctgtcgaggtccgtcgcaccaaggacggacacacgctgaccaacttcgggcagatcccgctcgacccgggcgcggtgcacggcggcgtggtgcaggacccgctcggcgtcaccacggcgctcaagcagctctgggcggcctcccggttcggcaccaagcgggtcagcctcggcgtcaccaacccgcagctggtggtccgcgagatgtcgatcgcgaacctgccggcctcgcagatgcgccaggcgctgcccttccaggtcaaggatgcgctgccgctggcggtggagcgctcgctgctcgacttctatcccctggagcagccgggcgacaatccgaccgtccgcggcctgctgatcgccatgcccaaggaggccgtggtcgggatggtccaggcggtggagaaggccggcctgcacgtgaccggggtcgacctggcctcgttcgccctgctgcgcgccgcctcccggctggacgcccaggtcgaggcgatcgtcgacatcggcgccgacatcaccagcgtggtggtgcacgccgacggcgaaccgctgttcgtgcggaccctgccgcgcggcggctcggagatcaccgacagcatcgccacccggctcgggttgccggccgatcaggccgaggagatcaagtgccggtacgggttgcacggcgacggcaacccggacaccgtcaccgcggtcgccgacgcggtccgcccgctggccagcgagctgcgcagctcgttcacctacctggcctccggtgagcggcagaagcaggtcacccggctgtcgctgtgcggcggcggcgcgctgatgcccgggctcgccgaacacctgcagaaccagctgggcatcgcggtgatgtacgcggacagcgcggcccggctgcgcgacacccgccgcgcccgggagcgtgggttcgacagtttcgtgccgtcggccgccgtgtcgatcggcctcaccctgggaggggcctgatgaccacgaccgcgttgatgccggtggacccgtcggtcaccccgcagcaggcggcccgcgtcctgagcatccgggccaacctgctcccgcaggacatcagtgacggccggcgggcgcggcgcacccgcaccgccgtgctggtcgccgtggtactggtcctcaacgggctgggctactggtactggcaggcggccgcggagcgcaaggacgccgacgccgagtacgcggcgatcaccaagcaggtggccgacgtccagcggggccagaacaagtaccaggaagtcgtcaagatcaggaaccggaacacgctggtcgagggccagctcgccaagctgatggccgacgacctgtcctggcaggccatgctcgacctggtacggaccaccggcaccgcgtccaagacgaccgtcacccagatcagcggcagcctgaacgcggccgcgctgaagagcgacggcgtcgggctgctctcggtcagcggcacggcgccggacaagaaggcggtcgccgactacgtcaaggcgctcgccgcactcggcaagaagggcctggccgacccgttcgtcagcaacgtggcgacggccgccggcggcggcgtgaacttcaacctgaccgtctcgatcaccgacccggcgctctgcggcaagtacagcgtcaagaagtgcccgtccggagggaactagatgaacctgctccgctccgaccgcgtctggctgttcggcggcatcggtttgatcgcactgctggtggccgccgcctggttcctgccgatcaagagccagtacaccgacgcggccaccgcccgggaccaggtcggggacgccaccgcgcagctcgccaagctgcgcaagaccctggccgacctcaacgtcgaacaggcgaagatggacacctacaaggccaacgaggcccggtacaagctggcgctgccgaccggggacgccatcccggccttcctcacccagctgcagacgatgggcctggacctcaacgtcgcggtcgacgcgtactcggcctccggtcacgacaagtcccaggtggtgccgaccgtcgaggagctgccgatcacgatcagcgcgaccggcagcatcgcgaacctgagcacgttcgtgaaccagctgcagtacacccagccccgcgcggtgctgatccagaccgcgaacctgcaggtctccaccaagccggacaagtcgacgctggacctgaccatgtcggccttccgcaacatcgctccggccagcaccgccgcggtgaacaccaactgaggccgcgggcccggctcaccgcagcagcggcgccatcgactcgaaggccgggcgtcgcaccacgtaccgggtcaggccccagcggcgctcacaccgctggagcttcgcgcggatctccgccgccgtcccggccagcagatagggcgactcggccgccgccgccggactgatcccggcgtcggcggcccaggtcgcgtacctgcggcccgcgtcgtcaccgatcgcgaagtagtgcaccagcgcctcgaccggcgtgcccccggccagctccacctgcgcgtccacctgatccgggtggaaccgcgcggtgtgcgtgtgcccgtccgcgagggtgcggcccaggccggagaggccgatcacgtcggcgttcgtggccgcccagcgcagcagctcggtgttcccaccaccgaacagcaccggcacccgctcgcgcaccggccggggccggtccagcccgtcgccggccagcatccgcacggtcgcctcggccaccgcgatgcagtggcggacccggccggccacgtccgggcgcacccggccgaccgcggtccactcggccggcgtgtgcccggcgccgatgccgaggatggcccggccaccggagaccacgtccagggtggccacgtccgaggcgatcagcagcggctcgcggatgccggcgttcaccacgtacggtccaagctcgatccggctggtgacggcggcggccgcggccagcgccacgaacggcgacgcgccgctgcccgggtggtcggcggcgtagagggcgtggaaaccggcggcttcggcccggcgggcgaggtcgagccagtcggcggcatcggccggctgagcctgcagcgagaaggtggccatggccggattctgcccaccgcccggaccggacgccgcattcttctgccgacggcagaccgctcccggacggcaaccccggctttcctggccgcggccggaccgcggccgatcaggagggtccacgaggaggagccgcatgaacgagaacctgatcctgatcgccgacgacgacgccgacgtccgtgacctgctgtcggtgagcctggaggcggccggcttccgggccgtgggcgccaaggacgggcacaccgcggcccggatcctcaccgtggccaagccgatcggcatgatcaccgacgtccggatgccggccatgaacgggatggagctgtgccagctggcccgcagcaccccgtcggtgcgggacatggcgatcctgatggtctccggcaacagccacgcctacgacgtggacgccgggatgatctccggcgcggacggctacctcgcgaagccgctcacgccgaaggacctggtcgccgaactgcagaacctgatcagccgccgccatccggcagcctgaccggcgacgccgggcggcgatggccgggccgcgcagccgctcgccggtgcgggccgggtcgaagacctcggtccgctcccacggtgtccggctgaaccggtgatgcagcaggtgcccggtcttgaaccgggcgaacggccgtccgcccggtgtacgtcagccgaagcggccgttttttcctacggcagcgcgaagggcagtttgatgccctgcagcgcgtcgccgcaggggcactcgcgctcggtgggcagcttggccaccgcgtccaggagcacgccacgcaggcggtcggtgttctgcgcgaacaccgcgaagacctcctcgtgggtcaccccgtggtcgccctccacgcctgcgtccaggtcggttaccagggcgatcgcggtatagcagagagccagctcgcgggccaggaccgcttccgggtgaccggtcatgttcacgatcgtgccgccgatcgaggtgaaccagcgcgactcggcccgggtcgagaaccgcggaccctccaccaccaccatggtgccgccgtccaccgcgttcaccctggcggcggaattcagcaccacggcccggccggccggacagtacggatcggcgaacgagacgtgcgccgcgccctcgtcgaagaacgtctgcacccgcccgctggtccgatcgatcaactgatccggcaccacgaacgtgcccggccccagctccgggcgcaggccaccgaccgcacacggggcgacgatctggcgtacacccagcgaccgcagggcccacagattcgcccgatagggaatcttgtgcggcgggaaccggtgatcgcgtccgtgccgcggcaggaaggccacccggcgcccacccacctcggccaccgtgatcttgtcggatggcggaccgtacggcgtctcgacctcgtgttcaatggcgccgtcgagcagtgcgtacaggccggatccgccgatgacgccgatctccgcgaatgggggtgacgggttcatgtgcagaccttatccatggccggaatcgcaagctaatgtgctgggcatggcgttgacgtcgaaccagcggcgggcagaccgtgttcggtgaggggcagcggatcggaggccggtcgatggagtcgatgaccggtcagctcctggtcgccacccccaccctcaaagatcccaacttcgaccgtacggtcgtgctgctcgtcgcccacgagccgggcggtgccctcggcgtcgtcctcaaccgggccaccgaggtccccgtcgccgaggtcctcggcaactggggggagctggccggcgaccccgccgtcctcttcgagggcggcccggtccaacccgagtcggccatctgcctggcccgcacccgccccgaggtgaaaaagcgcctgaccggcttccacccggtcgccggcgccctcggcaccctggacctctccgccgacccggaacacctcaaggagaacgtggccggcatccgcgtcttcgccggctactccggctggtccgccggccaactggaggaggagatcaccgccggctcctggttcgtcttcgacgccctccccggcgacccgttcgtcgaacgccccgacgacctgtgggccatggtcctgcgccgccagggcgacatcctggcagctgtcgcgcacttccccccggacgtctcgctgaactgaagggggtgctgcgaaggcccgcggcggggtgtgtagtatttccagcgtgcccgggggaaacgccggggacacggcaggaagcagtgcaaggggctgtggcgcagctggtagcgcaccacactggcagtgtgggggtcaggggttcgagtcccctcagctccacccttgtaaacgcccggacttcggtccgggcgttttcttttgccatagcgcggaaggggtcgggccggatgggccaccaaccgggacccgatcatgagcggtgggaggccttcgcgctggaggctctcgatcgagtcaggcagcggcaggccgcgatggtcaccggacacggggtccagggcgatgtgcagtattagtggtcgatggacgacgcccgcatcgtgttctcccgcggaggccgggagttcctgcatgggcggatcacggtgatcggcagcgtcgatcacgcccagcagacctggctgtggtcgtgggccaacgattctctgccgcaggcggtgctcggcgacatcgccggcgtgcgcgacttcggggagcgacatggcttccccctgctggtccggcccggcttccacgcggagcagaagccggtggcgcaagccaagacggtcgccgcggatgtgctcgatgccgagggactgtggttccagccgggcgacgagatcgacctgcacttcgccatccacggtctgcggccggtctgagcgggaagggccggcggccggcgcgggacgggtcaggcttcgccggattcgcggcggcggagttcctcctcgcggcggcggaggtccgcctcccaccggcgcatcaggttttcgtcctcgcggcgggaggcggccaggccgcggaggaactccgggtcgtcgtccggggcggccggggcacggcgggtggggcgttcgttctccgggaagccggcgccggggcgccacaccgtgccgttgctgaggtggatcgggcgggccgggcggccggcgacgaaccaggcgatcgggccgatcggggagaacagcaggatcaggaggacccagaggccgcgtggcagggcgcggacggcgtattcgtcgaccgagagacagtcgatcagggcgactacgatcagcacgaggtcgatcagcccgaacagggagtagaggcgaaccacgccgcgatgatgtcagagcggggacgagcccgctgcccgaacaggcagcgggttcgtaacgaacttggacgtcagaaagctttcaggatgtcgttgacccggtccttggcgtcaccgaagagcatcgcgctgttctcccggaagaagagcgggttctgcacgccggcgtaaccggacgccatcgaccgcttgaagatgatcacttcggcggcctcccacaccttcaggaccggcatgccggcgatcgggctggacgggtcctcggtcgccgccggattcacggtgtcgttggcgccgatgaccaggaccaccgacgtacgggcgaaatcgtcgttgatctcatccatctccagcacgacgtcatagggcaccttcgcctcggcgagcagcacgttcatatgcccgggcaggcgaccggcgaccgggtggatgccgaacttgacgtcgacacccttctcccgcagcttgcgggtcaactcggccacgccgtactgcgcctgggccaccgccatgccgtaccccggcgtgatgatcaccgattcggcgctggtcagcatcttggcgaccgcgtcggcctggatctcccggtgctcgccgtagtcgacgtcgccggacgggccggcctcgatgccgaaaccgccggcgatcaccgagaagaaggagcggttcatggccttgcacatgatgtacgacagataggcgccggacgatccgaccagcgccccggtgacgatcagcaggtcgttggagagcaggaagccgctggccgccgccgcccagccggagtagctgttcagcatggaaacgacgaccggcatgtcaccgccgccgatcgaggccaccaggtgccagccgagcagcagcgcgaccgcggtgaccgcgatcagcagccacagccggggatcgatcacgaaccagacggtgagcgccacgaaggcgaccagcgcgccgacgttcagcaggttcttgccgggcagcaccagcgggcgcgagttgatccgcgcggacagtttgaggaacgcgacgatcgagccggtgaaggtgaccgcgccgatgaagacgccgatgaacacctcggcgtggtggatgccgagcaggccctgggcggagagtgcagccgactcgccgccgtccgggtctccttcgacgtgcagataaccgttccagccgacgagcaccgcggccaggccgacgaagctgtgcagcagggcgatcagctccggcatcccggtcatctcgaccttggcggcgcggtacaggccgatcgcggcaccgatcgcggtggcgaccaggagcagggccaaccccgtaccgctcagatcgccttcgacagccagagcgatcgtggcgaccagcgcgagtgccatgccggcgacgccgaaggcgttgccgcgcttggcgctctcgtgccgggacaggccggccagagccaggatgaacagcagggcggcgacgaggtacgcggcctgggcggacgttgcgagagtcatcgggtcagctcctggtgaacatggcgagcatgcggcgggtcaccgcgaagccaccgaagacgttgatgctggccagcaggatcgccgcgaacgacagcacggtgaccacggcgccgccgtgtccgagctgcagcagcgcgccgaccacgatgatcccggagatcgcgttggtgaccgacatcagcggggtgtgcagcgcgtggtgcacgtgcccgatgacgtagtagccgatcacgatggccagcgcgaagaccgtcagatgcccgcgcaacgtcgtcggcgccagggccgtcagcaggaacagcgcggctgcgccgacgccggccaggggcagcgtccgattcctggtcgcggtcgccgccttcggcgccgccacctccttcgtctccggggccggcgcggccgagaccgacacggccggtggcggccaggtcaattccccttgccgtacgacggtgatcgatcgctggacgacgtcctcgaagtccaggaccaggtggccgtcccgttccggggtcatcagcttcatcaggttcaccaggttggtgccgtacagctgggacgcctgcgcgggcagccggccggccaggtcggtgtatccgatgatggtcacgccgttggcggtggtgacgacctcgccggccaccgtgccctcgacgttcccgccgttggcggccgccatgtcgacgatcacgctgcccggcttcatgctggccaccatgcgctcggtgatcaggcgcggggcgggtcgccccgggatcagcgcggtggtgatgacgatgtccacctcggcgcactgctcggcgtacaaccgggccgcccgctcgttgtagtcgtccgacatctctttggcgtacccggtcgacgagacctcgacgtccgccgcctggaccgcgaggtactccccgcccagcgacttgacctggtcggcgacctcgggccgcgggtcggtcgcccggacgatcgcccccaggctgccggccgcgccgatcgccgccaggccggccacgccgaccccggcgaccagcaccttcgccggcggcaccttgcccgccgcggtcacctgcccggtgaagaaccggccgaacgcgtgcgcggcctccaccacggcccgatagccggcgatgttcgccatcgaggagagcacgtccagcgactgcgcccgcgagatgcgcggcaccgcgtccatcgacagcacggtgatcggccggccggcgaactcggcgaccaaggcctcgttcagccgcgggctgaacaccccgaccagcgtggcacccggcttgagccggtccagccgcgccggttccggcgcgttgatggtgaagacgacatccgcggcgtacgggtcgccgacggtcgccccggcctccgcgtacgcctcgtcggcgaacgacgcgcgacggccggcacccggctcgaccaccacttcataaccgagtttgagcagctgggcgacggtcgcgggggtcgccgcgacccgcttctcgccggggctggactcccccagaacaccaatgatcataaatcgactccccagcagttctagcgacgttgccggacctacggcggaaacgtgaatgtgggtgtcttcacggatgccgaccatgaacgcgttcaagggatgagcttgttactcgtgggtagcttaacgtttcgacatgaccgctgtcacactacaactcatcacatcactcacagtgaccacaaggtgagcgcgcatgtcaacggcccccgcctcgcacacagcgagccgggggccgtcgacgtcatcggaaggtcagcacaccgagcgggttgtcccgctctgcgtgcggcccggccgccgtcggcttccgagccggtcagcgcttcgcgggcgcccccacggtcgcacactgcggtggggcggtcggctcgccgaccgcgacgaggttccggttggcctcggtgggggtggcgagccgggtgaaggccgggccgagggtcaccgcgatgatgtcgtcccggatgccggggtcgaacagcatcgtcgcaccgtcctgcagataggcccggaccagggcggccgagccgatcccggccgggccgtagctcaccgaggcggcgccctccaggggggatccggtggcgccgttcagcacggtgaaacgacgctcccgcaggtgggcggcggtcgcgtcgatcagcgcggtggacgcgccgccgtccagcacccggatccgtacctcgacgggatcgtccggcagggcgagggagcagtgcagcgcggcggcactgggcggcggaccgccggccaccaggtcatcgaccggcgcgggccgctagctagctagcggccagatgacggtgacaccggccgtggccaccagcgccaagccggccgcggtcaccacggccagccggcgccgcgaccgctgccggccgcgggcgcgaacctcggcggccggcggcaccggcaggtcaccgacctcggccgcaagctcacgcagtcggtcaggaacgggacgtgacatcgctgatctcctgatcgttgtcgccgagcagctgggccagggcggcacgggcgcgggagagccgcaccttgaccgtcccctccggaacgccgaggctctcggcgatgtcccgcaccggcatgtccagtaggtagtagagggtgacgacctcccgctgcgccttcggcaaccgctgcagcgcggcggccaccgccacccgatccggcgacggtccgccggcgacgtcgtcgggcgggccgagtcgggcccgggcggccacccaccgccgcagcccccgccaccggttgatcagcaggcgcgaggcgacgacgcgcacccagccctccgggtcgtcataccgcgacacccgcgaccagtgctgccaggcccgcgcgaaagcctcatgggcgacgtcctgcgcctcggcccgatcaccgcagctggcgtaggcgtagaggagcacccgccggaccgtagccgcgtagaaggtgtcgaagtcggcgctgtcgtcgcccgccatggttcccgcttccgtcggtgcccgcacacttgaatacacaccgcaccccgccacccggttactcgtccccggcggatttctcccgggctcggcgacagggccggccttaccgctccggtccaggcctggaccggattcccggggacgtgtgggtcagcggccggcacgttaggttggtgccatgcagagcagcgtcggcgagcgcatccggcgcctgcgcaccgagcgcggcctgacccagcgcgagctcgccgagccgcgcttcagccgcgcgctgctcgcggccgtcgagtccgggacgcgccagcctagtccgtcgttcatcgggtatgccgcgagccgcctcggcgtcgacgccgacgagcttcgccacgggcgtcccccgggcacggccgaggacctcgccgcccgattgacggccgcccgccgtgacctgtcgcaggggcgcatcgacgccgcggtggccgcgttcgaccaggtccgggccgacgccgtccggtacgcgttgccggcgcccgcagcctgggccgcgtactggcggggcgaggccgcgctgcagagcggggagctgtccgccgccgaggacgcgttcgcaccggccctcgactgtcccggcccggtcgagccgcgcgccgccgccatcgcccgatgggcctattgccggttcgccgggggtgacacctcgggcgcggtcgacgtactggagaaacacttggccgtgctgcaggaatcgccacagtccccggcggacgcgctggtgcggctgggcaccgcgctgatctacgcctacatcgagttggactggcgtgaacgggcccgcaacttggaagacgagtcgcgggcgctgctgccacgggtgcgcactacggaatgggtcgcccagttcctcgtcacggcgggccaggcacggcgtacggcggccgagctgcccggcgcgcagcgcatgttcaccgaggccggccggatctatgccgagctggggctgacccgcgagatcgggctctgccactgggcacacggctatgtgctgcgccgggccggaagcctggaacccgccgcgggcgagttcaccgccgcgtgcacggtgctcgactcggtcggcgcgcggcaggacagtgcgggcgccgcgctggagctggccgaggtacggcgcctgcaggggcggctcgacgaggccgacgcgctcgccgacggtgccgcgcgggtctgcgccgagttcggccatcaggagtgctcggccgaggcggaccgggtgcgcggcctggtcgcagcaggtcagggccggccggaggcggcgcgggaactgctggcgcgggcggccgaccgctacgcgcgcatgggcctcgcggccgagctggcgaccacctgccgcgagctgggcgacgtgctgctggccggcggtgagcctgcgcaggccgcgctggtgttccgccgtggtctgcgcgcagccgagacgatccggtgaccgcggctttcggcgggcggctgcgcgagctgcggaaggcccgcgggttcagccagcgcgaacttgcggcgccgcgctacaccgccgcattcgtatcctcggtggagtcgggccgccgcgcgccgtcgacggatgccgtcgcgtacttcgctgagcggctgggtgtcacgccgcgcgcgctgaccacaggcgaggatccggatcatagggtacgcgcccggttggcgctcgccgatgcggacgcgcaggacggggcggcggacgcggcgtaccggaaattggcttctgaagggattttcgagccgcaatgccggctcggcctcgggcggctcgcgctacgacggggcgagatcgccgacgccgcgcgcgagttcgccgcagccgcccggctgctcgccggggaaccggcacacgtccgtgctcacgcggtcgccggtcaggccgcctgcctgcgcgcccagggcgacccgcggtacgccgcccacctgctgcaccgggtactgaccgaaatggacctcgcggctctgccggatccggccgccctcgtggcgatccacgcgcaactcgccctctgccacgccgacctggaggacgagacggcagcggcggcctcggcgtcggccgcactctccctggccgggccgcgcgaggcgggctcgcttgccgacctgcacctcaccgtggcccgcacgctgctgtccacgaacgatctcgccggcgccgacctcgccctgcaccgggccgggcaggctcggcagcaggcgaccctggcgccggaactggcggcctgccgattgatcaggggccgggcccgccgtaccgccggcgacctgccgggcgcgctgcgcgacctctcgccggtggacggtccggtatcggctgaggcggcggtggagctcgccgccgtctatgcggacctggggctgcgcgaccaggctcacgacctgctgcccgagcggttgccggctgccgaccggctgcgcgcccgactcgccgaggaagtgggcgaccacgaggcggccgagcaccacctgcgcgtcgccgccgacggctaccgcacccggggcccccgccgcgaactggccacgacgatcctcgctctcgccgatctcctcgaccgccggaaccgcccggaagacgccctcactgccctgcgcgatggcctcaccgacgtgctcggacctggcatcggcaaggcgtgaaggtgcggcggtcccctcccccggggaccgccgcaccggtcgcggttcagccgggtcagcagggaccggcgtcggtccagaccgcccaggagcccggcgcgcccggttcggcgccggtggagtaccaggtggagttccagaggtggccgttgtaggaggccttgtcacccgggacgtacgggcgggtggcgctccacgccgcgacgccgccgcagccctgcggcggggtgccgcccgagaccgtgagcgtgtaggtcgccgtgcgggtggccgcggtgccggtgccggtgacggtcaacgggaaggtgcccgccgccgccgtcgaggagaccgacaccgtgagggtcgcggagccgccggaggtgaccgaagccgggctgatcgccgcggtcacgcccgtgggagcaccggagaccgcgaggttcaccgtctgtgccgagccgccggcggtggccgtgacgaccgacgcggtaaccgagttgcccggagcgaccgtggccgaggccgggttcaccgagaccgagaagtcgttcgccgggggctgcccggtcgtcacggtcgtggtgtaggtggcggtgtgcgagccggacggggccgtgccggtgatggtgatcgccttgctgccggtggtcgcggtggccgacgcccgcagggtcagtgtggccgactgcccggcggtgaccgtggcggggctgaacgtcgcggtgaccccggacggcaggccggacgcggtcagcgtgacactctgcgcggtgccaccggtgacctgggtggacaccgtggtggtcgtcgagccgccctgctgcagcgagccggacgacgggttgacggcgagcgagaagtcgccggccggcacggtcgtgcaggacggctcgcccgactgggggccgacgctcaccgcgctccacgccgccttggtgctcgcgcactccgccgagctcgcgccgaacaggttgacggccgccttgacggtcgcgccgcggtacttggcgtagctccagccggacgtcttcatgttcatcgcggacatgaagatctggcccgccttctggatgctgacgccgttgacggtgctgccgtcacaggtcgggctcgccgggttgccgttggccgggcggctgccctcggccagcaggtagaaccagtggttgagcggcccggcggcggagtgcacctcggtgcccgggatggacgacgagtagcagttggggtcaccgttggtcgacgggttgtacatgtagcggatcggcccggacccgaccaggttgatctcctcgccgacggtgtagtccggcgggtcgctcgggttgtcggcgtagtgctcggtcagggcgccgaagatgtcgccggtgccctcgccgagcccgttctcggcggccgtgcccgcaccggtgtactggtcgatcgcgtggcccatctcgtggccgaccacgtccatgctggtggcctgcgcggtgttcgacgagttgtgtccgaacgtgcccgacgagccgccccagtacgcgttgacgtcgttgagcccgacgtagagcgggaaggcgctgccgttgccgctgatgccgctgcgtcccagccaatcgcgcagcatgttccactcctgctcgacgccgtagtacgcgtcgacgcacgccgtctgcaggtcggtgccggtgcccgtgccgccgttgcggtaggtctgtctggtgctgtagttgccgcacgacaggcccgggcgggccgggtcctgcagcacgccgccgttcgtgtcgatctgcaccgccccgttgacgtaaccgcgcgccgcctcggacacgacgtcttccctggtgaacagcaccttgccggtgcccgcgtccacccagacgtgcagcctgctcggcgcgtcgtggcgaacgcccgagaccagcacctggtacgcgagcagcggcttcgcgcccagggcatacacgacgagctgcgcctgccccgccgtcgcgacggagtcgagctgccggcgagcggtgccgaccgcctgcttcgcggggatcgcgggccgcagattcccgagcgacacccgaccgtggtccgcggcgaacgtgtcacgcacgtggcccgccgcgtcgacgacgacggtggcgtccccgccgactacgggcaggccgcggtacgtacggtcataggtcaggtaggagtagccgccgagtccggtgatcgcctggcggcgcaggaacgcgtcgtcgggccccttgccgagggcgtcgaaaccactcgccgcggctttgtcggccgccgccaatcgcacctgttcggtgacgggggtgccgctcgccgcggccggttgcgggggtgatgcggcgtgggcgctcgtgatgcccaccgccagggcggcgccggtagcgaacgccaccgtccccgccagcacggttctgcttctcaccagaactccttcttcaggacggccggaagctgctcgtgacagcctctacctgctgatacgagtcacttaacaagtgttattgcacttgtggcgtgaaccataggccgacgcccgcggtgggtcaatagccatcagtcgatgttctggtggggtcggcggtccatgcagcacttccgcagaacgacgaactgcgcatcgagccggccccggccatcccggcggcatcgtggtatccgtgcccggcatgggcgaagtgctgcgaccgctgccacctcgaccgggtggagtaccgggccgggagttccagggtcgccgccgaacgccggtgacgcccgaggtgttcggccgacctggaggccacgtcgacctcatgcaggaacgggcagccacacccgctatcgggatggccgggccaaaatcctcgctggcgcgtacggcaaggtgggcatcaccaacgggcaactcccagaggaccggcgatgacgtttcgtggcaggacccagatggtcaccctgtggctggccccttccgtactgattctctccgcctgctcaggagccggcgtggacaagcagtccgagtccgacgtgaacgcagtcgttcagcaacacgcggaacagatcgccactgcggtgggcatgccactgttcaatccgaaactgagctccggcgggtgcaccgaccgggccggcgaaagcagcgacagaatcttcactgttcagggcgtctacaacgtcaacccgccacagaaggaccagcatctcgcctcgctggccaggatcaaagccggatggcaggccaagagttaccgcatcaccgacgaccgcacggtagggccggacgacggtctggtcgccgctgaaaccccagacggctaccgactcgaggtcgaccgcgccatccccgacggcttggtggtcctcatccactcgccctgctacgcgaaaccgtgagcagtggcggtggccgccgcctacttggacctcggcgaccaggtccggcacctcgaagacgctgtcagtaatcgaggtccgactgacaagccatgacgtaaccgccgccactggtctgaccttccgcgtccgggcctccgctaccaggccgaaccgaacctgccgatcgaacgtagtctcttttgccggcatcggatgacggggagtcacttgaatgcagccgaacatggagatcgacgtcgagggcctggttcgtacgggaacacaggtgcaggactcatcggggtcggtgcgcgacgccatcaccaaggagacaggcaatccacgacttcccgcgagaggtcggctggatggacggcgtgccggccaccgaccgcgacaaggccaaccggatcggcctggcgcagcagaagcagtacctgcaggaccggctgcacaaccccgacatgaccctggaagcgcacgacacctacgacgagttgcaacgcctggagacgatcgagaagggcctggacaaactgggcccgcgaggcttgctgctcggcttcgacactgcggcgttcgacggcgatggcaaggtcatcatggcgatgggcaaccccgacaccgcccggcacaccggcgtctgggtgcccggcatgggcacgacgctcggcggcagcacgctggacaacctcgaccgaatcatgaagatgaacgatgtggccgactcaataacccgggatcggtcaggtgacatctctaccatctactggctcggctacgacgcgccagagttcccaccggccaacttgtcagtcgtggcgaacttccgctcgatcgcgggcagggacccgtacatcgacttcatgcagggcctgcgcgctacccatgagagcggtgacgggcatctggtggcaatgggacactcgtacggcaccacggtgctcggcgaggcggccaagacgcatcggcttcccgtcgacgacatcgtcaccgccggcagcccaggcatgcacgtcggttccgccaatgacctgatggccgacccccgccacctatgggccggcgcctccgactccgacccggtcgcccgactcgaggcgtacacggtgtccggcgactcgacagtagacagctcgccgctgaccgaactcgccaacaagatcgcagacgatgaccacggcctggcacccagcgatccgagcttcggcggcaacgtctggaaggctgacacgtccgggcacacacactactgggacgacaacagtgaaagtctcaacaaccagtcgcgggtgctcgctggcgcctacgaccaggtgacgtacaacagcggctcgattccggagaattggcgatgacccgaaacggaactgtccgcaccgtggtggcctctgcagcggccgccttgtctttgacattgttcgcctgttcaggagcgcacgtggaaaccaagtcagagaaagatgtcaactccgcggtgcaacagcacgcggacaacatcactaaggttgccgccaagccgctggaggacccgaagatgcggtccggcccgtgtaccgacccgatgggccgggacagcgacacggtctacaccgtgcagggcgtctacaacctcgcaccgcccgccaccggcacgcacctcgatatcctcgccaaggtccgcaccgattggacgagcaagggatacaccatcaccgatgaccgcaccgtagctgccgaccgaggggtactggccgccaagaccaaggacggctacaacctcgacatcgagacagcaaccccggacggattcgccatcatcatccactccccctgcttcgagcgccctgactgaacggcggatgccgacaccgcaccccatgccgcaacggccaactaggccaacagcgcagcacgccccacgtaacgcggcgcctgggccccggttcgcggaaagcgcgaaccggcacgtccggtcacaccgggcactgggcggacggcagcgagagtttgatgaagcagtcccgagtgctcgtcagtacatacgaccagatgacgttgaaccgcgaacgattccggagaactggcgatgaccggtcgtagcaccgtcacggccgtgacggccctgctcgccgccgtggcattcaccctgtccgcctgttcaggagatcaggtggaaaccaagcccgaggctgacgtgaacgcggccgtgcagaagcacgccaacgccatcgccgcggtcgccggtcaggcgctgcagaacccgaaggttcgggccggcgggtgcaccgacccgaacgagaacgtcagcgacagcgtctacaccgtccagggcgtctacaccctgcccgccccggccgccggcgagaagcacttggacgtcatcgccaaagtccgcgacgactggaaggccaagggctacacgatcaccgacgaccgcaccgtcgccgcggaccgcggagtcgctgccgcccggaccccggacggctacaagctcgacatcgaaaccggcgacccgcgcgggttcgcggtcttcgtcgactccccctgctacgcacgcccctgaccggaaacgcggaaagagcccactgactccgcagccgcccggacgggccacctacgaaggcagtggacgctgatcctgcaatcaggatccggatcgcactccacaggcgtgttcgagacgacgtcttgaaaacacagcgcgcggccacaagaagcagccgcagcagtggaccgcgccacaggcaacggaccgcgaccaacgtaacgcggggtctgggggctcggcccccaggctggaatacggaacggcccccggttcgcgctttccgcgaacagggggccgcaatgccgtggaggtagtcgcctcttacttgaacctcatcgaccaggtccgacacctgcaagacgccgtcagtgatcgaggtccgactgaccggccatgacgtaaccgccgttgacggtctgacctttggcatctggacgtccgctaccagcccgaaccgaacttgccgatcgaacgtagtctctcttgacggcatcggatgacggggagttacttggatgcagccgaacgtggagatcgacgtcgagggcctggttcgtacgggaacacaggtgcaggactcatcggggtcggtgcgcgacgccatcaccaaggagagcggctggctgacagtcgccggcgccgccgcaccctgggctgccgtcgccaccatggcggatcgcgcccacggctgggcgacgtatctacaggacctggcggaacggatccggctcagcggtgccgggatggtcggcgcggcgatcgactaccagaccaccgaccacgattccggcaccgacatcgccgggacctatccggcacccggcccgcaccacggcccgcacatgggatacgccgaatgagcacgatcaccttgcaggacgtcgccgagaccaacgtggccgccttctcgtcagcctccgacgcgtgggatcgggtagctgcgaacctcgacgccggcttggagaagttcatcgccgccggccagcttttgcctcatgtgtggcagaccgggtacgcggcccaagaccgggtgtcggctttgcaggcggagttgagcggcacgtacgacccgtgcaagatgatcagccgagctctgcgcacccatgccgacacggtgctgagccttcagagcatgctcagcgacatccaacgcgaatgcgccgcggccgggctgaccgtcaacctgacgaccgcaaccgtctcctcgaaaggtcacctcacggacacgtcgcaggtgctcagatggccggactggtgcagagctacaccaggcagctgggcgagttgctgacccgggccaggagcctggaccaagagaccgtgcaagccctcgctcagctgcctccgtcgcccggttccggcaagaccggcccgaagatcacccaggacgatctggccggtttgaaaggcaaaacaccggcgcaggtgcacgcctggtgggaaaacctgacccgcgggcagcaggaccaagccatccacgacttcccacgcgagatcggctggatggacggcgtgccggccaccgatcgcgacaaggcgaaccggatcggcctggcgcagcagaagcagtacctgcaggaccggctgcacaaccccgacatgagactggaagcgcaggacacctacgacgagttgcaacgcctggaggccatcgagaaaggtttggtgcaggtgggtccgcgcgggctactgctaggtttcgacaccgccgcgtacgcgggcaacggcaaagtgatcattgccgtgggcaatccggacaccgccaggaacaccggagtgtgggtgccggggctgggtaccacgctggaaggccagacgtccggcaacctcaagcggatggtcgacatcaacaacgctgccgacggtttcacacctggccaggatggcgatgtctccaccatctattggctcgggtacgacacgccagagccttacaacctttccgtattgcaggacacccggtccgtagcgggtagccagccgtacgtcgacttcatgcagggactgcgtgcaacgcacgaaagtgatggtggccacctggtggccatggctcactcgtacggctccacggtcgtcggcgaggcggcgaaaaccggccatcttcccgtcgatgacatcgttgtggccggcagccctggcatgcacgtcggctcggccagcgacttgatgaacgatccccgccacgtatgggccggcgcgtccgacagcgacccggttccgcgctcaggtgccgtgctggactccgctgcggtagtcaacccccaacttatcgaatacatcgaacacagcgccgacgccgaccacggcctggcaccgagcgaccatagcttcggcgccaacacatggatggccgataccagcggccacacccactattgggatggcggaagtgagagcctcaacaaccaggccaagatcctcgctggcgcgtacagcaaggtgggcataactaacgggcagcttccggaggactggcgatgacatcaagtggcaggacccagagggttgccctgtggttggccccttccgtactgattctctccgcctgttcaggagctgacgtggacaagaagtccgaagccgacgtgaatgcagtcgttcagcagcacgcggaacagatcgccaccgccgtaggcatgccgttgttcaacccgaagctgagctccggcgagtgcaccggaagggccggcgaaagcagcgaaaaaatcttcaccattcaaggtgtctataacctcaacccgccacagaaggatcagcatctcgcctcactgggcaagatcaaggctgagtggaaagcgaagaacttccgtatcaccgacgaccgcacggtagggccggatgacggcctggtcgccgctgaaacccccgatggctacaaactcgaagtcgaccgcgccatccccgacggcttcgtcatcctcatccactcgccctgctacgagaaaccctgagccagcggtcaaccgcaatatcgtcaggaggccgcgccccgcgtaacgccgagttcgtaggctcgaccccaggctggaatacggaacggccccggttcgcgctttccgcgaaccggggccgccaggcagtggaggtgttgacctcttacttgaacctgaatgaccggttggccaatatccgacgcatgcttcggacggtcgtgcacaactctgaacaacatgcagctccgcacgctcagcatcaatagaagcggactgtagatcggtcgcgaaagctacagaggttccgaatcctctacccgccaccacaggcgcaaagaagcccctcaccagttgaaaagcggtgaggggcttctcgcgttggtccccactgggtctcggttaggaccgctcgatctcactcgtcacggcaaatgcacggcaaaacttcatcaggattccccgggtcgtcggcttctcgggcatcggctctgagcaccctgggcggcccgtagagcaggttgacgccctgccgaccctcggcggcgagccgctgctcttggactgcgacgggctggtctgctcgatcttcgcgggtactcagcgccacgtgttgtggccgaactggtggcgctgctcgatgccaagggcgtcaccatgccggccgaacttcgcaacgaacaggatctcctcgcggtacttcgctgggcggccgagagcagtgcgcacaatgtcacagcagcccttaaggaagcactatgcgctggcagcagccgaactgcgcgccgccagcgtctcaacgcccacgcccttcgggacgtgaggtgagcctcggcgcacacgcgcggcctgccgatcgcaaaggtgagcaaacaacggcaacagcgatcgaggcatacctagaggcccccggtctcgccccgttcgtagctccgatcatcggccgggccttcgccggtccatggcggataaagccgaaccctgagccggtgctagccgccgggcacgcactcgtgggccaggccggactgctgcgcgatcgtcggcggctccctctccgacatcgaggcgcccgcgaggaaggaatcaccgtgatcggctatacgaacggggattggaaattggcaggttcagatccgcccacatcgtgatgacgtcgaaggaagacatagccgcgaccctgtcctccgtgtcccccgagctcgattgaactgcgaaaacgacggtgcaatgaaagctgcaggtatcccccatccgcccggccgcggtcacacgccgccggtcagacttacgcctcgccgcagccaccaagctgcgtgccggtacatacggtcgagaagcggcgcaataagtgccggcatggctctaggcatcgtctacgcagcgatcctctcactggccaggcggtcaagggtcaccacctcggcgggcccagggtgctcgacggacgcaaccacgggttcgctgtaagagaaactaagacgctgccaacggcttgcgtactcggtcggcacgccgttgtcggccacgatcagctgcagccgatcccgatatgtctccgcaagagtatctagctgtcggtaaaggttggcagcaagggcctcgccagccccgatcgattttcttggactgtccaggattagacatcctggcatattcgtcgccgggtctctcagagctaccgagataagcgagacccaatacgcgacgacgagtgcggttctcagtccaccggtactaatcttgtcaaaacgatctccattcacatacgggagatagcttcgatcatcaattcgcacagaggtgacgctaggtacgccgaaatttgacagcgttcgagcatactcttctgtcaacgcagcaagcacatcctccttcgcttctttaataatcgcctcacggcgtcgtatgtcatccttgagcacgtctcgccgggttcttgcttcctgcacggcccgagacatgtctgcggctcggtcccagtacctaaggcgctcttcgagcgtttttactctttcctgcgtcgttccgaccgcagcactcaagtcagcgaactgctgcaaacgcgggctcaccagttctcgggtacgctcatccacaacgtgagcgagtttcttcgcctgctcttccgtttcctctaaagatgaacggatttgatctgttttttctgcattggatgacagaagttcttttaactcgtccaattgataacgaatttggccggcttcgtacggctcatcgttccagctagtccctgtccgcgtctcaggctgaaggcagagtcggcagtgacctcgttcaacgactcgcccttcaatactttgggtacagcgaggacacactataaactcaatgttcgcaaggcggaggcccgcgtcttgcgcacgctcgaaccgagccaagtcctggcgaagacctgcagcaaggttaagccgttcctcgtgcgccttctccaaaacgtttagttcgcgcctaaggtcgtccgccctatcttgcgtagtcacaagcagatcgcgcaggaggtccgtttgagggtcggctggatcagcatcaagactcaattcatgcaatcgcgaacggtaaccatttagttcttctattgcctcctcttgagccaagagtgtcgcattttgcggttcagcaccaacactctccaggaagttaagtaccgtagactcttcggattccgcttctgtcaccctttgttcagcagtctgcaattccgatttgagcgtaaggagttcttcgtccgtgaggccgaagaatagttcaaacacagtccggcgtttaggttctctgtagctatcgctgtgatgagcgatgctcctgtcgatctccggctattcgacgtataggctcgaccaaatgtcgttgaaggtcacaacgctcggtttgctggtagcgcgcgagcttagagccgaagcccttacgtccgcaggaaggcccaaggcagttaagaggatctggccgatagttacctctgccttgccacgggcctccgccgggaaaacgcccaaggcctcgcgtgagcgaaggtcaaaggcatggacatcattaaccccgctgtgcgtagcgcggcgcagcgcaagccgctccgcccccgcggcaatccgaagcgttacgctggatatgtgctctttcaccacgggactaaagcgtgctgagccaccgagcccatgttttattaattctattagcgtgctcttacccgtcgctacgggaccatcaagtaccgtgagtggcccagtgagttcgtaggcgacggtgccgcccgtagtttccagttcgatatagtcgactcgaaaatacttactcatgggcgtatcaactctcgatgcggacgatccaagatctcgggaagtttctcatagattaactctttgagcccattgccactcaattttccgacgtgctccgccactgcctcgcaccgttcggccgtctccatccaagctggggcaccctgcagctcgctgacaatcttccttcccatggctgtagggcggagcgcaacgctgcccttgcctccacgggtgtaggcaagaagacctttgccgaccaaagctccgataacggggtaataccggttgtcccagggcccgtacttatagcgaatcattggagactcggtttcacgataatcgtcatccgaaggcctcagccggctgtcgttcccaagaccttcagaaacccgggcagcgagagtcggataacgtaccaagaaatcgagcttggcgagtttcgttaggccgtccagctttcggccggcaccaggggtgcgcgatactgcattgacaagcaacaggatccgcgcttggtgatacgcgctgtcaatatccaggccagcttggcggtgcgtcaatattgtcatgcggcaacctctccgcccgtgcccggaggtgcgccatgactcacacgcaattctgcctgcttagcgtcgacgtcaaattcctgactgaaccagacctgacagcggctggctaagtcgcagacggcacctagtgctgtgagcgtttcccgaggcagcggtaaggaccccaacgcatctactagatctgcactatcaagctttcgccacattctagaaccgtacttaccgccgctagattcctcggcagcctcttcggcaattttgctagcgacgtaccgcaggcgattctcggcgagctcgaactcctgagacatcccgggcacagccgcatactgatggcgttctcgccgccaattctctgcgaagcgctctgcggtgacgattgctgtggtggtgcagccgccctctaatagcttcgcggcaaggcgagtagcagcaatcttaagatcaggcatggcatacgcggcgggggccttcgctgcttcctcaacggcaaggattacgtcttgggccgtgactatccgtcggcgtagcgtccggtcaagacgctcggcagccgtttcgcctttgatcctggcgatgaggtcacttagctcccctagaggaagcttccccctgcctcgcattctggtccggaagatgcctaaaacggcattccacgcagccttggacgccaaggttgataggccgagctgttcgagcagtggctcaacgtacttctctggcgcgcacgcctcgacatcgtcggcttgaggacgagatgtatcaaactcaatgctgtggaggaacgcacggatatcatcgagaaggccctgcacagggactatttggctcttcgtagccccttcgggggcacgccattccactggaatgtccgctttgtctggaagacgtagcatctccacagcgaaagatcggatcatcgttgcggagtcggatgtggcagcccctgactgaagttgtcggcacacgtcccggagccctgaggcatcgtctccgcccttgagttctgagtttgtgaccatgcggcatcctaggtcgcgtcccaggcccttccatcgtgcgtacaggtgagccaaaccgccgtcatcggcaagcgtggcccacgtgtaggcgcctcggccaagtcccctgtacttgacggatacgatctgaacatcgtcaccgtcgatgagtgcgtaatcttcgtggtgctcgcacaaaactgccttcaacccagcggcacctcgggcctggtctttaaggtgcatggtggcgacggcgaaactatcagccgccgccatggctgcctgccagtcgaagaggtctgccgtgtgcgccccggcgtcttcgggcgggggagttccccacaacctttcgcgtgccgtcacgcaggcactcccctctgcggccctctgtgtttgcattgtggcgcaacgtgacgtcagatggatagccctcttgggctttcactgctaccagcggtattcatacgtcgtcacatcgatggggagttgggtcgtcgagctgtcacccatccccctggggtcccaactgcctcggggtgggcgcgtgagccctgcacacagccggctaggtggtaatcgcgctgcgacgggcgtgcatgaaccggcgtttcacgtcctcgaccaccggtcctggacaacccaacaacgactgcgaaccgccatcgtgacctggatcgaacggacttctcattgccgccgtcaacgatcgctagctcggttgaaccctatcgagaacacgacatcatcaccgcgtcggccagtcaagccgcgtgactcgttctgtcacctatcggttcagcagacctagcgtcgctggactgagcgcgtggagcgaccgcctgccgcaagttacaacatcggacctcgatgctgtacagcatcgggccaccgcacctgagataacgacgggcttccgacgaaaccctagccctatgaagttgagtcccccagcgttgacctaagcgtcccggtcagccacctatgggggcagatgtgagcatcctcggccctctgatcgctcttgccggtgtcctcataggcgccatactgtcgtacgtattctcgctcaagggtgagcggcgacgggagaggtgggctctcgaccgtgagtggagggagcgccgccttcagacctatagtgagtacgtctccgacgttaaacggatgaaaagcatcgcggcgcgcatcgccgcaggccttgggctcgacgatcaatctccaccgcttgacagagagacaggcaagaacgtgctggccgaagccaacatggcacggggaaactcctttgagacgctcgcgctgatgggtgatcaggcacttgttgaggctgccagggcgttgaaccgcgcagtctggcgtctggagtggttcgcccgcggtttgctggatgacacagatgtagaaggctgggacatcgcgacgcgcgactactaccacgcagtgaacgattttcataggctcgcccgccatgaactcggtgtgaccggcgtattttcgcctagagaagctgaaggctcgccacgcgagcagtacgagctagatcgacgaaccagaggacgaaggccaatttgatcgaccggcacaaactttagttgctctccgggaacgcttgccatgatctgaaagtgttccgctaagtttgtgaccctcgtcccgactaattgcgagcaaattgatctcgacccagccctgctcgctcaccgctagctagctagaactcctgctggagtactagctggtcgaccaacacatcctgcatgcgcctcgctcaacagtctctcgctgctccaggcgccgctaatgagctaccgtgccgctgcctacggcgatactgacctgcccggcgtgaccgcatagctcggtccgccgtgccccgccgctcgtcaactgctactcggaactgtgcggtttgtatagacgccgagtgggacggcgagaagttccacggacgtccaacaaggcgcggttgggctagcgcccaggaaattcgaagctgtgagcaacgccgaggtagctgcgcaccaggggtcacgaggcgccccgaagccgtgcggtgcgggtggcaacggcgccaaccagggtccggtcgtgcatgctcccacaagcgcacgaccggacctctgcttgttcgccagcttgcggaggaagcgatgccacactcgcgtcggcatgcatcggcctcgacaccgccgaagcaccgcccagcaaccatccatcgaccgtcacgccactggtgggcgccatggcgctcacgctgtacctgcgggctcagcacttggccctgccaagccacatgttcgccggcaccggccataacgcggagcacggcaacggccggctccacgccgagagttcgtcagcgtccgtcctgggacatgccgacaatcctgctcacgccgctattgacccgcggacagcgatggcgcagcaacggcggcgccgaatgagcatccacgtgctgcacgtccctgagcgaccgtcctggaaatgccatcactgcagcaccctctggccctgccaaccggccaaggacgacatcatcgccacgaccgatcgcgtcaaccggatgatctacctcagccttcacctggccgacgccatcgtcgatcagccagacgctaaaccggccgacctcttcgaccgcgtcgtcggctgggcctgtagatcctgagccaccgcccacaccctctcgaacgagtcgaggtaggtggccgcgatcccatcgtcggtcgcccgtcgcaggtgcaagacgggcgaccgcgatgcggcgcacccgtaggcatgggtgttgaccatcaactggtcatcggcccggtagatcgaggtgtagagcacggtgtcatgcgtccgaaccgccacgccggcttcttcgatcagcggtcggagcagggccaaagcgttgttgatccgggccggcattatcgccccgatctgctcttcgactccgcgctgggccacctggacgccgttgacatcaccaagcgcgatacgcacccgcacgccggctcgggccttgtcgcgcagtatcgccacggcgcctgcgtcctccgcgagaaaaagaccgctgtaagcaagtacgccgatctcctgctcggcaccagcgaacagccttcgccaggcatccggcggcacggagcagcgctgcgcgtacgtcataaggatgtcgccggtatcagggggggcctgctcccgagcgtcgatgccgggccagagatcgggttccgcccagcctgtgagcccagccagtgccgcgcggtgccgcgggtacggcaacctgcccgtcagccaccgctcgacggtcttgggatcgacgctgagccgcgcagccacgtccacggcatcaagtccggtggcgcgcagcgcccgagacagaggttgcttcatcacgtccctccgctggagtggagttccggccagcatagccaagaagtcccaagacgtcccaagacgaggttcacagtctgtgatcgtccggagatcctggatcgagcatgcagatctgtctggccggctgcccggctcggcacccatgacgaccgaacaagagggagggccgacagtggccgacgacagcctcgccccggccacagccgcgcaacaggccgccgatcgcctagcggttgccctcgaagaggccggcttcgacgtcggtacggccttccaggatctccgcagcggatgggacagttccggggcacccggtgtccggatcggtgccgtcacctgcacggttgcaaacgacctcgcggcactgctgaccagcgcgattgaggctggcgtgacgctcccccgcacctgaagcggtgaccactacgctcggctcagtaaagagggccgggaggacggacaccgttggcaccacggacgacagcttggggtgcgtacaagagcatcgccgcggccattcgcgcccggatcgccgagggcgagtttcctcctggctccgcgcttccgtccgaagccactttgtgcagccagtacggcgtatctcgcaacaccctccgacgcgccctagacgaactcgcagcagaaagtctcctcgtcgcccagcccggccgtgggcggatcgtcgtcgacgacagcgaggcgagccatagcgccatgccgcaataccgcagcgtggcagccgaactccgcgctctcatcgagtccggcgagctagctctcggcgacgctctgccgagcgaatctgcgctggccgaccggtacggggtcgcacgaggaacggtccggcacgcgctagccgaactagaaggcgccggcctcgtcgagtcgattcacggaagaggccgtttcgttctagggcgatagtctctgacctgtgggagacgtctcgtgggcgcgtgagctggcggaaaagcttctagtcgatacgttgccgcgccgctgggcacattcgcagggcgtcggtcgcaaggctgaatcgatcgcccacctgctcggagacgacgctgacacggtcgtgtgcgccgcatggttgcacgacatcggctacgccccggacctcgttcacagcggctcccacgccctcgacggcgcgcggtatctgcgggacgtcgcagaagccgacgagacgatctgccgccttgtcgcccaccactcctacgcgatcgtcgaggccggccgccgcgggctcgccacggagctcgccgaggagttccctgcggtgaacgggctgatggccgatgcgctggtgtactgcgacatgaccacgagcccagacggcgaccccgtagacgtggaaaagcgtctcaaggagatcgcctcgcgatacgccccgggaagcatcgtcgcggactccatccttgaagtcagcccacgcatcgttcagtcggtgcgggtcattaccggcatgcccggcttccaagccgattagccagcaggtttatccgcctgcgcaagggtgccctgctcatcacgtgtccagcgccgccccgcgctgtcctgaaactcgatctggatcggctccggttcgacataggagcgcagccagtctgcgggcgccggccgccggatggtctggcccggcggcaccaggccgacgaactcggtgacctccgggccgtccgggctgggcagcggcagctcaacctcatagatcggcatgtcactggcgttgtggatatgaaaggccagctcacgagtgccatccgccttgcggtgcagctcgacccaagcgctgatcttcgcggcttgagcccgccgctcgtcgtcggaccgccccgcttcccgtcgctgctccttacggagcaacagaaaaccgaccaggaacgcgcctacggtgccgacggccgagaagctgtcggcagcgtcgccgatccatcctccgtcagccaaggtacggctgctcctcctgcgccaggtaccggtcgatgcgcatccgcatcgaccggtgcatcgtcagaccgggaatggcgtccggctccacccactccacctcgcgggactccgagctggtcgtgggctctccgctgacagcgcgggcggtgaagaccacggagaactcttgacgcgcctcgttgtcgctggtgtagaggatgatgtgccgaggatcggtgtagatgccgacgagtccggtgatctcgaccttgatcccggtctcctccaccgtctcccggatcgcggcctcgggcagcgactcgccgaagtccatcgcaccacccggcaacgcccagttgtcgttgtccgtgcggtgtatcaacagaagtcgaccccggtcgtcggtcaccacgacgttgacggacgggacgatcgagttcgcggcgggcgcttcgggatcatcgaagtagtcgatacggcgtgacatgaccgatgacctcattccaacggggtcgcgccgtcccagacgcgctcgaagctgtccaggtagctgctgaccatggtgccaccggcgaccttgcgcaggtggagaacgggggcctctgccgcagggaagccgtagatatgcgtgttgaccaggacctgatcgtcagcgcggtagatcgagttgtagagcacggtgtcgtgtagccggaactcgatgccgtcgaggttccgcaacggccggtacagcaccagggcattgcggatcttcgcggccatggcgtcgtctacgccttcatccgctccacgctgggcgaccgattcgctgttcggatcgccgagcaggatccgcaccagcacgccggcatcggctttctctcgaaaaactttgcgtacgccggcgtcctccgagaggaacagcccgccgtaggccaagacaccgatctcggcctcagccgtgtcgaagaagttccgccacatttcggacgggacagcccagcggtgcgggtagatgttgacgatctcgctctctgaagcgtctgcgacctggctgcgtgacagcgcgtccggccagagataagcctcgtcgactccgagtttcgcggcgaccgcgtagcggtggcgacggtaaggcgtccggccggagatccatcgttcgacgctcttcgggtcgaccttcagttcctcggcgagatcggccggggttactccccgttcgaggagggcggtgcgcaggcgatcgttcggcatcgtcttctcaaactaggacgtctcgacaagacgctcactttaggacagacatcttgcatacgtccagctacgtagtgatcacgtcccgctgatccgtcgcaagctcgttggcatcggcgcaagagcgccggacccaccggaagcccacccgttcgcatctccttgacgcttctaatgaacatgtacaacatgttcattagataggaggttcggatggcacggcttcgcacgaaaggaggcatcagatgcccacccccgccaacgagcccacctgcacctgcggcgcccagctcgacgccgaccaccccaaccagtgctgcaagtgctccgcccggagccgctggcagcggcgccacgccaacctcgcccggcgcaccggcccgggccggaaggccagcggccggggcaaggacgggcggcgccccgcatgaccgtgaccgtctccgccgtgctcctgctcgccgtcttcgtctacctgctctggcggttcgccggcctgccgctctggcaagcggcgatctgcgctgtcttcggctatctgctcgccgcgtcctcgatcggcccgaacatcggggacgccctgcacagcctcgttcggatcatcgccaaggcccagctctgatggaaggagacgcgatcgaccccatgagcaacgtcccgcgacccgtcctcgacgaggaggccatctggaaacacctgaaaaccgcgctcgacaggcgcaccggactcgacatctggaccgccgtagccgacctgccgctcgtgctcgccgaggtggaacggctgcgcagactgctcgcctggactcgcatcgagcacgccaatctgctcgccgctgctcgcgcggccctctccgcccaggcggacggggaagaagatccactcttctacgtacgcgacgaagtggccgcgcagagggaagcgcgatgagggcgtacgggcggcggcaccgccgctggcgtcgtcacgggcaaccactgcttctggtctcggacgagtcctggttgtcggcgatcctcgccggtatcggccggctcgcccaccgctaccgttctgaactcgcccccgccacggtcgccgtcgtcttcgacctagtggccgtctggctccattcagcgcaaccaggagcatgctggtgggtacttgccggcaccggggcggcgactctccgggcagcactccgaggggcgccgtggggtgccaccagggccgaggaacgtgcctacgccgcgatcactactgcggttgccggtgtctggctcgccgccgcaacggcgctcggaccgggccacgcacacctgcaatcggtcctcctggtcgccatgttcgcgtgcgggaccccgtggtggcgccaccgacgacgccgggcacgggtgaaggtcgaccgcacgatccaggcctggcccaatctggccgaacagatcgggctcgccggttcccgggtgctgtcggcggcggtggacgtgtggggatggcgcgcccggatgacgctgcgaggcggtcagaccgtggcggacgtcatcgcccaggtacccgcgatcgaatccggactcggcacccggcccggagcggtccgagtcgaggccgacccggctcacgccggtcggttcgtcatgcgggtgcttgccgaggatccgcacgccaacgccgtcccatggcgcggcccggccgcaagatcggtagccgatccgatccccctcggcgtgttcgaggacgcgaccgacgtggcggtgccgatgttgcgccggcacgtcctcgtcggcggcatcgcgggcgctggcaagagcggagttctcaacgtcataatcggcaacctggtcgcgtgccccgatgtggtgctctggggtatcgatctcaagggcggcatggagctacagccatgggcgccctgcctcgcccggctggccaccaccccagccgcagcggagacgatgttgcgggacgcggtcagggtgctcgacgcacgtgctcgtgcgatggcagagtccgcgtcacggctctggattcccaccgagcgcaagcccgcgctggtcatcgtcgtagacgagtacgcggagcttgccgagcagtcgcccgcagccgtcgagtacgcggactcgatcgcccgtcgtggccgcgcagtcgctgagaccctgctcgcggcgacccagcgtccaactcagcaagccatgggcaagggcgccatccgttctcagatggacgtgcgggtctgcctgcgcgtccgggaacgtcgggacaccgatctcatcctcggtcagggcatggtcaccgccgggtggcatgcgcacgacctggacgcacccggcaaattcctcgtctccgccgagggcttcaaccacccacgccgagcccgcgcctacctggtgaccgacgacgacgtccgagccacggtcgagcgatacgcagcagatcgcccggtcctggaccacctgtccgccgacgcgctgcacgacgaagctgacgcgctgcacgacgaagtagatgaggccgaccccgagaaagtcctctgggcggcgctcagcgaggcacccgagcacggcctgtccgtccccgatctcatgcgaatgaccggaatgaggcgcacatggatctacgaccgcctgcaagccaacgccacgcaggtcagccgtggacgctggcgactgccaaacggtggatagtccgcgcggacgtccgttcccgcgcgcgcgtctgcgcagctacgggcacggacggacgacggacggatgaagcggcgcgagccccgccggaagcgccgacatcggcccgtacgtgagatccgcatcgatccagaaatcctcgcgcgagtcctcgtcgcgatcgccgaggagatgatccacgactgaggaggaaccgagatggcgcagattccgcgccagcacgaccggccggcgagcacgcacaagcgagcattcagctacctgcgcgtctcgtcggccgggcaggtcaacaccgactacgaccccgaaggcatctcgctccccgcccagcggtcggccatccagcggcgcgccgccgagctgggcgctgagatcgtcgccgagttcgtcgagcccggccgctccgcgacgaccgtggacggccgaccggtcttccgggagatgatggctcggctcaaggccgagaagagcgtcgactacgtgctcgtctacgcccggtcccggctgcaccggaacagcatcgacgcggcgatcaccaagcgggacctccgcagcgcgggcgtcacgctgatctcggtcatggactacaccgaggactcagcgatcggtgacctcgtcgccacggtgctggacggggtcaacgaataccagtcccgcgcctccggagcggacatcgcgtacaagatgggtcagaagatcatccggggtggctcggtcggccgggctccgatcggttacctcaacgtccgcgagaccttcgagggccgagaggttcgcacggttgccgtcgacccggtgcgcggcccgctggtccggatggcgttcgagctgtacgccaccgggacgtacggattccacgcgttgatcgcggccttgagcgatgcgggcctgcgcaccaggccgaccaagcgcttcccgatcggtacctcgatctcgctgaactcgctcggcaacctgctccgcgaccggtactacctcgggttggtctcgctccgcggggttgaataccaggggcgacacgagccgctggtctcccccgaggtcttcgatcgcgtacagcagatgctggaatcccgacgggcaggtggggtccgggagcgcacgcacaaccactacctcaaaggcgtcgtctggtgtcacagatgcaaacggcggctcatggtcatgcgcggtaagagccacaccggcgacctgcacttctactacttctgccgcggacggcagcagcacgcctgcgacctgccctacctgccaatcgccagggtggaggcggccgtcatcgacaactacgccaccatcgcgctgcctgccgacctgcgcgacaacctcaccagccgggtcggtgagctgctagccgagtcggctggcatgagcgccgagctgcgtacccaggttaaagatcagctcgccacgctagatcggcaggaagatcgttttctggacctcgtcggtgatcccgactggccgcaggacaagatcgcggcacggctccggaaggtccgggacgagcgggaccggctcgcccggcagctcaacgactcagacgctccgcgactcgacgaggccgccgagacgatgctctacctcctcggcttgctcgccgatccgcaggagttgtaccgccgggccggacagcagggccggagagcactcgatcaggccttcttcgcgaagatttacttcgacagcgacgacgacggcccatatgtcgccgctgacgagctgtcagatcttgtatttccgctggtcaacgaggtccgaaacgacagcggcggcgccatgggcgccgccgctgcgggtgaaccgtcacccgctctcgcgggttcaagtaagcctccacttgtggaggtgccgggaatcgaacccgggtccttcgttgttttgtcagggcttctccgagcgcagctcactatgtccctactcggccctccgactcacgtgagcaagttcggacgacgggcccagtcactgattaatctcgccgcgcggtccccgtgaccgggaccggttggccagcctcctagcttatgccggcagctgggacggaggcgctcccagaccgacagaccacgctacttgcctcaggcggcgagagcgtactggtcagcgtcaaacttagagttggcgcttataagtttccgacgaccgattctcgagacgacgtcggcttcctcggctcgcttcccctgtctccacgtacgaagtcgaaaccagtcaccccctggatattggtacagcccgacaatcttagctcactatccggtgaccgccaccgagcacccgacccggaggcggcgggggtcgtcggcggagccggagaagccgaccatcacgttgctgtgcggggcgagcgcggagctgccgaccagggtgatcgtctggccgctggtgctggtggcgcgggagttccaggggttgttgagcacccggacgctaccggagaaggtgaaggtgacccggaagctgtgagcctgcgagccgttgttggtgaccgtggcgttggcgacgaagccgccgttccacgcgttgatgccgcagctgaggctcaggtcgcgggagaccggcggggtggtggtcctggtgacggagggcttggggctcgccgaggtcttcgacggtttcggcgaggccgacgtcctggacggggagggggacgccgagggcgaggtggcggcgaccgccgggccgctggagaccggcgcggtcccggtggcggacgggacgacggtggactccgcggcgcgcaggccggtggacggctggaccagcagcggggtgtcggcggccgaggcggaggagccgccggcgcgcagggcgatccaggcgacgaggctgatcaggatggcgccggccaggccgaagacgccacgggcgatgaagaactgccggtcacggtgtgggggattggtggacaacggccggtctcccgatcaagaaagcgagcaggggggatgtgatcaacaagcctgggcggggcaggataccccgtcaggccatgcctttggcacggcggcccacggcgcggttgatctcgcgcttggcatcccgctcggccatgtcctgacgcttgtcgtagctcttcttgcccttggcgacgccgatctcgaccttcgcatacccgttctggaagtagaccgagagcgggaccagcgtgacgccgtcgtcgcggagcttgcccatcaccttgtggatctcgtcgcgcttgagcagcagcttgcggacccggcggggctcgtggttggtccaggtgccctgcgtgtactccgggatgtgcaggccgtgcaggaagatctcgccgttgttctcgtggccgaacgcgtcgaccagggaggcgcggccgagccgcagcgatttcacctcggtgccggtgagcaccatgccggcctcgtacgtgtcgaggatggtgtagtcgtggtgcgccttgcggttggaggcgacgagcttgcgcccctgttcgcgtggcataccgcggactcccatcgacgagccggattgaactgggcaatcgtagcgcggaccctagcagaggcagggcggcaggtaattgagcggattgcggggcgcaccgccgaatcgggtctcgaagtgcaggtgcgagccggtggacgcgccggtgctgccgaccagaccgatgatctcgccctgccggacgtactccccgacatggacgtagatccgggattgatggccgtaacaggtggagaagccgatccccatgacccggccgtggttgacgcacgtgtagttgccgtagccaccgtgccacccggcctggatcacccggccggcggccgcggcccggatgggggttccggacccggccgcgaagtcggttccggcgtgcaactgccagacccggtagtacgggtcgtagcggttgccgtagtcgctgctcttccagccgtgcaccggcatcagcagccgcccgtgatactgcccggagtatccggagcggacctcccagccggccatgctggaccggatcttgcgttcctcggcgaccgcggcccggtactgggcgagcaccgtggcccgctgggcgttggccgcgctcagcgccgcccgccgggccagcaccagctggtacacgtcgcgtttggcgcggaccgcgtcgacctgggcggtctgcgcctcctggagcttggcggcggcctcggcctcggccacctcggcggcccgtttcgccgcgccggcgcggtcctgggcggcccgggcctcccggcgggcgccgatcagcctccgcacgtcgtcgttctcctggcggaccatctcgtcgaccatgctcatccggtccatcaggtcgaccggtccgtgcgccgagaccagcaggttgagccgggtgatcgggctgcccatgtagctgttgcgggcgatctgggcgacccgctcccgggcgccggccacccgctgctcggcggcggtccagtcggcggcgatcgtctggtagctctgccgggcggcgtcggcccgcgtccgggcggtgtcggcctcgacccgggtggcgatcctagctagctagcggcgttctccagcagtgcctcggcccgccggacggactgggcggcctcggccgcgtcattctgatcggccgatgccggtgcggggacggccagggtgaggccgacggcggccagcaggcagagacaggcggtcagcagcgggtcgagtcggcggtacctcacggtgagtcaccgtactctgactaaacgcccggatcgctgcaaacccgcccgaatacggcgaaggccgcgacccggtgacgggtcgcggccttcggcgcaaaggtgatcgggacgtcagaccttcaggtagaaccggagcgtcacccaggcggtcccggcactgacgaccgcgccgaccccggccagcagcggcagcatcagccagacgttcccggcgggcaccggcgtcaggatcgcggtcaacgcctgcagcttgttgtccagcagcacgatcttgccgatgaacagcgcgacgaagccgaggatcgagccgatcaggccggcgaccaccgcctccaggacgaacggcgcctggatgaaccagttggacgcgccgaccagcttcatcaccgcgacctctcggcgcttgctgtacgcggcgacctggatggtgttgccgaccagcagcaacgcggcgaaagccatcaccgccgccaccacgagggacatcagctggaccgagttgaagatgttgaacaccttctgcagcagctcgcgctggtcgatcacccgctggatgccctggctagcctggtcgccgagagcctgagtgaacttgttgtagtcctccgggttcttcagcttgacccggaacgactgcggcaggctgtcctcgttcaccgcggccacgaagtcgggcgagtcggcgtagaggaccttgaaccgctccagggcctgcgccttggtctccagctcggccttcttgaccagcgggtcgccgctcagcttcgcctggagagcctggatctgaccgtccgagacgttgtccgccaggaagatcgacacctcgatctcgccgtagtagaagttcttcatccggtcgacctgcaggtacatcaacacgctggcgcccagcatggtcaatgagaccgacatggtgatgatcatggcgaccgtcatcgtgacgttccgccacaggcccaccaggacctcgttgaggacatacttcacgcgcatcggggggatccttccgggactccgcgtgtcactgtttcagcaaacatggggtgggcggagccggtctcagccgtagacaccgcgggcctggtcacggacgatccgtccgctttcgatctcgatgacccgccggcgcatctggttgacgatgttggagtcgtgggtgaccatcacgaccgtcgtgccggtccggttgatccggtccagcagtcgcatgatctcgatcgaggtgtccgggtcgaggttacccgtgggctcgtcggcgagcaggatcaacggccggttcacgaaggcgcgggccaccgcgacacgctgctgctcaccacccgagagctcgtgcgggtagcggtgctccttaccgccgaggccgaccagctcgagaacctcgggtaccacccgccgagcgaccgccttcgtcttgccgatcacctcaagggcgaaagcgacattctcgtacgcggtgcggttgggcagcaggcggaagtcctggaacacgcagccgatcgagcggcggaagtgcgggatcttccaggagcgcagtgaagtgacgtccttggcgttcacgacaaccttgccgcgtgtcgcctggacctccttcaacagcagcttgatgatcgtcgacttaccggaaccggaggggccgatgaagaagacgaactcacccttctcgatcccgacgctgacattgtccaacgacggccgagacgccttcggatacgtcttcgtcacgttctcgagctgaatcacgggactggagtctacgcggtgtaacgaaaacgccaagcccgccggggtcgggaatctttgccacctgcggcaacagcagaacgagacggccccgcactgaccgagtgttcaggcggggtcgctcaacgtgagaaatcttgttaggccgcgctctggttctgcttgcgccagcggatgccggcctcgatgaacccgtccacgtcgccgtcgaagaccgacatcgggttaccggtttcgaactcggtgcgcaggtctttcaccatctggtacgggtgcaggacgtacgaacgcatctggtcgccccacgatccggtggtgtcctgcttcagtccggccatcttggcctcctcctcctggcgcttacgctccagcagtcgggcctgcagcacccgcagagcggacgctttgttctgcagctgggacttctcgttctgacaggtgacgacgatgccggtcggaatgtgcgtcagccggaccgccgagtcggtggtgttgacgctctgcccacccgggccggacgaccggtacacatcggtccggagctcgttgtccggaatgtcgatgtggtcggtctgttccacgaccggcatcacctcgacgccggcgaagctggtctgccggcggccctggttgtcgaacggactgatccggaccaggcggtgggtgccggactcgacgctgagcgtgccgtaggcgtaggggaccttgaccgtgaaggtggccgacttgagaccggcctcctccgcgtacgacgtgtcgtagacctcggtcgggtagccgtgccgctccgcccagcgcagatacatccgcatcagcatctcggcgaagtcggcggcgtccaccccgccggcgccggcccggatcgcgaccagcgcctcgcgggaatcgtactccccggagagcagggtgcggacctccatctcctcgatcgccttggtcagcgcggtgatctcgtcaccgacctcggcgaccgagccggcgtcgccctcggcctcggccatctccagcagcaggccggcgtcgtcgagccgggtgcgcagccgctccagcttggagatctcaccggagacgtacgacagacggctgttgacgtcctgcgcccgtgcctggtcgtcccagaggtccggagcggatgcctgctcctcgagctccgccttgttacggcgcagcttgtcgacgtccaggacgttctcgatgttgcggagggtggcgtcgagcgctttgagttgctcagggaagtcggcagcggtcacgacactcaagaatacgccgtccggccagatcactggccggggcgtcctcaactcattcggacggaacggtcttcagccagctgagcgccgccttgtggtacgccacggcgaactccagcgcggccgcaccgtacgagtcgtcgttcttcttcgcctccttggcctgctccttcgccatcgccagcgcctcggcgtggtactggttggcgttggtgtagagggtctgcagctgctcggtgctgtgttgctgaccgaaggcgactcgcagcgcgaccgggttgcgcagggcgtcccggccgggcgtctcggtcagccagcgcccgaaggcgcgcttcccggaggcggtgatcgcatagggctgactggaacgcggacccggcttgccgaggcggacataccccatttcggccagtacgggcagttcgcggtagacctggctccgcgtcatcgaccagtagggcccgaggcggcgttcggcagccgccatgagctgtccgccggtcatcggcccctcgtgaagcaggccgagcagggcggcagccgtgggattgatctggaagtcgggcatgccttctaagctgccactttgtcggtccgccgtccaggatttcgcacgatccgtccagtttgcgcctccacaaacgactgtcccgcacagacagtccgacaacgagcgcgcagaccgggcgtttcgtccgtcgataggcggttgaccaggtaagatggcgcattgaatcggccagacaggccgtgccgggcaggaaagccccaaatcggtccgaaattgtcgagcacattcggacagtcttcccatctgggtccaatcccgatggaacgctcagtgaccgccggtcgggcccctccaggtcggcctattaccctgacccccatgaccgacgcccaggccacgacggccgcaccggagaccatcgaggagtcccggctcaccgtggccctgctcacggccgccagcctcgcctggaccgtcgcgatgctgtattccgcccgggccagcatcaccggacgcgcggacgtcgccatggaggtcacctccacggcgtacgcgatgcccggcgcggtcgccgcggccatggtcaccggcgcggccgtggcgctgctggtccttaccctgatcaacgggcggcgggcactcggcgccaccgcgaggttcgcagtggccacggtcagcgggctggtcaccggagtgctgtgcgcactgccgatcatcacgatcaacatcgacggcacgatgtacgccgcggtgggcgggacggtcgcagcggcggcgacgatcggcggggcgctggccggcttccggatcccgccggtgatcgcggcagccggggcggccaccgtcggggtgttcctgatcggcttcgtgctcaacaacaaacacgtgcagaacccggtgctcgacctgctcggctcgggttcgaccgaatcggcggtcaaggcgaaccagtacttctcgtacgggcagtcggcgatcagtgggctcgccgccgggctgatcgccttccgggtgctccggcggcaccggcagcgggccggcggggcggacctgcggtggccgttctacctgatcgccggggccggggccggggtgctgtcggtgctctccgagatactgacccggacggcgggggcgcaggtcctcgaactcgccgggaaggtcagcgaactggagaagtcggtccagcagatcctcagcaccaaccggctcaacagtgggctgatcgtgctgttcgtcggggcgttcacggcgatggtcgcgatcggccgcaccctctcccccgctgacgacgaggacgactacgaggaccatccgggcgccaccgacaccgcgcccggtgccaccgcaccggctcccgacgccgccgcgcgcactcccgaagccgccgcccctcaaaccgccccgaccgctcctgaggcccccgcatccgtggccgccaccggctccgctcctgcggcgacgacagcgggcggcaagtctgacatcgtcgggacgaccgctgttgcgaagtccgacgtcgcggatgccgcgacccggccccagcaggccgagccgatcgaggcttcgtcggcccccggggcgagcgccacggacgcggcggtcggcgaccgaaactgaggttccggcttgaaacagatcttgaactagcttctgatcttgatcgagttcactcgccgatctcgtccagttctgtcaccgcgtaccactccagctcgtgatcctccgcctcgtcgacggtgaactgggcgtccgggtcgccggccagagcctcctccacgacgacggcggccgcggcgaccgcctcggacgcctcggccccgtccacgtggatgctcgcgatctgctccagacgaagcgcctcgggcagccggaccgtgctcgaaccgagctccgcatcctcccggaccagcgcagacgccggcacgtcggcggagaccacgacccggcggcgggccgccccggcgtcctgacggagcagccgcagcgcgtcctgggcggcccgggtgaaggcgacgtactccaactcctcctcgtcaccctccgcataccactcccggagcgcgggggtgaccgcgtgcgcgaccgtcgccccgtcgccgagccggcccgccttccgcagcgccgccaacatcggcagggtggccggcacgtagacccggaccagctcggtgatcggcacgttctcctccagcttcgccatcccggtcagtacaccgccgccgcgggccgggagagggtcaattccaccaggcgttcccggaacggggtcacccgggatgatgtcatcggcaaacggtggcaaactcaagcggccgtaaccaacgaagggtgggaggccacggtggaggcccggttcctgttgctgtccgacgtggcggccgagctgaacgtctcggactcgcaggtctatcacatggtccgcagcggcgagctgcccgcgatcaagatcggtgggcgggggcagtggcgggtcgagcgagccaggctggaggagtacatccagtccaagtacgcggagaccgccgcctgggtgcgggagaacccgctcgccgagcgcgagccggaatgaggcttttgcgcctctttccggatcgatagagggggcgcgggcaaggttgaccgtcgcatgtggcggagccagacttacgttgtcgaaggcaaacggaggcaaacgtaaggattggcggtggagatgcggtcggctgtcgacagcgcgccagccgggaccagggcggttcggttacgtccggttccgcgctacgaacccccgttcgacgacgagctggcgcctcagctgtggtcgccggagcagcagctggcgctcacgtggccgcgcccggtcgtcacgggggcggccgggcgggcggggccaccgccgatagcggcgccggaacgggagcgggggccggggtcttcgccggaatgtggtgggggcgggtcccgggtcggccgggcggtcgtctcgggcgatcagcgcaaggcgggaagcagccgggacaggccggcgggcggcggcgagcatcgcggcgccgaccagggcggcggggaccagtgcggcggcgagcagtgcggcggcgagcacggcggcggcgagcacggcggcggcgttcacagcggtagcgaccacagcggcggcgttcacagtggcagcgaccacagcggcggcgttcacagcggcaaggaccagggcggcagcgttcccggcggcagcgaccagggcgggtgggcgagcggtggcggtaacggcgagccggcgggcggtggccgtaccgggctgttggggtgtcatccgtggcgggaggggacgccgtgggttgatccggggcggatcgcggcgctggcggcggtgccggtggtggcggggccgtccggggaggcgaagctggcggtcaaacggttcgtgcatctgtgcgtcgaggtgctcaacgggtatcgcccggcgacccacctccgtcgactgtcgctgccggccgaggccgccgaggtggtcgcgcaggggctcgcgggcgctcgccgggtgtcggccatgcggcgggccaggcggcccggtgatcggcgcccgcagcggccgtcaccggtcgcggtcatcaaggtgaacctctgccagccccggggcggcgcggtcgaggccgccatcgccctggtcaccggcgagcgcacctgggccatggcgctacggctggaactccaccaggacacctggttcgccaccgcgctccgcctgatctgaccaccgcgccacgtcgggtcgaacgctacgcctgggccgggcacacgccaggcccgggccacgccgacggcaggccacgcccggccacgggccacgccaacggtaggccatgtcccggtcacgggccacgccgacggcaggccacgccgggcaccaggtgggaaccggcggggcaccgcctggcgcttgagccggggggaaggggtctgggcggtgggttccgagagcccggcggacggaggccaggcagggaggggtccgtccggcggatgaaggtctgggctggaaggcgtccatcagccgaaccgaggcccggtccgggaggggcagggagtaggcacccggggcggctgctgcgcggtggaggtggtgggcgttccgggccgaaacagggagcggcccgtggccggcgggtagccgggcacgggccgctcgtctggtgctggtggatcccacggtctggcggatccgatggtgctggcggatccgatggtgctggcggatccgatggcgctggcggatccgatggcgctggcgctggcggatccgatggcgctggcggatccgatggcgctggcgctggcggatccgatggtgctggcggatcagatggtggggtgggtcagacggcgccgggggcgccgtggcagcgcttgtacttctttccggagccgcagtagcacggggcgttgcgggacgggccgttcgagtcggcttccttggcggcgtggcggccggcggtggtgtgggccgggttcgccgggaccggggacggggcgccgcccgggccgaaggcgaccggcggctccgcctgcggctggatcaccgggctgccgccgcccgcctcgccgtcgatggcgggggcggtgtactgcaggttctgcggacggttgccgccgccgagacccttcgcgcggacctcgacgtgctcgtgcggctcgtcgaccggggcgtcgtccggcacctcgccgaccttgggcagctcgaaggcctgggacgggtcgacgttgacggtgggctgctcctcgacctggacctccaggttgaagacgaagccgacggcctcctccttgatgccctccatcatctggttgaacatgtcgaagccctcgcgctggtactccacgaccgggtcgcgctgcgcgtaggcccgcaggctgatgccctcctgcaggtagtccatctcgtagaggtgctcacgccacttgcggtcgatgaccgcgagcagcacctggcgctccagctcgcggacggcctcgctgcccagctcctcctcgcgggccgcgtacgccgcctgcgcgtcctgcttgagctgctcgaccaggaactcctggtcgatcgcgttgcgctcgccgccggactcctcgatcaggtcctcgatggtgagggtgaccgggaacaggcgccgcaggttcgtccagagctgctccaggtcccagtcctcggcgtagccgtccgaggtggcggcgtgcacgacatccgtgatcacgtcgtcgatcatgtgggtgacctgctcgtgcatgtcctcgccgtcgagcacccgcttgcgctcggcgtagacgacctgccgctgcttgttcatcacctcgtcgtacttcagcacgttcttgcggatctcggcgttctgcgcctcgatctgggtctgcgcgctgcggatctgccgggtcaccatcttggactcgatcggcacgtcctcggggatgttgaagcgctccatgaccgcctcgaccgcgccggcccggaaccgcttcatcagatcgtcctgcagcgacaggtagaaccgggactcgcccgggtcaccctgccggccggagcggccgcggagctggttgtcgatgcgccgggagtcgtgccgctcggtgcccagtacgtacaggccgccggccgcctgcacctcggcctgctcggcctcgcaggcctccttgacctgcggaagcacctcttcgagggccttcgcgtactcctccgggttttccgccgggtcgaggccgcgctgcgccagctcctgggcggcgaggaagtcggcgttgccgccgagcaggatgtcggtgccacggccggccatgttggtggcgaccgtgaccgcgcccttgcggccggcctgcgcgatgatcgtggcttcctgcgcgtggaacttcgcgttcagcacgctgtgcgggatgccgcggcggcgcagcagggtggagaggatctccgagttctccaccgagacggtgccgaccaggaccggctgaccggtcgcgtggcgctcggcgatgtcctcgatgaccgcgctgaacttggctttctcggtcttgtagatgacgtcggggtgatcgacccggatcatcgggcggtgcgtcgggatggacacgacgccgaccttgtagacgctgttgaactcgccggcctcggtctgcgccgtaccggtcatgccgccgagcttgttgtagaggcggaagtagttctgcagggtgacggtcgccagggtctggttctcctgcttgacctccaccccctccttcgcctcgatggcctggtgcatgccctcgttgtagcggcggccgtgcaggatgcggccggtgaactcgtcgacgatcaggacctcgccctcggggctgacgatgtagtccttgtcgcgcttgtacagctccttggccttgatggcgttgttcaggtagccgaccagcggggtgttcaccgattcgtacaggttgtcgatgccgatccggtcctcgacccgggacacaccgcgctcggtgatcgcgacggtgcgcttggcctcgtcgacctcgtagtcgccggcgccgtccttgcccttctccagccgcttgacgatggcggcgaactccgcgtaccagcgctgggagtgctcggccgggccggagatgatcagcggggtgcgggcctcgtcgatcaggatcgagtcgacctcgtcgacgatcgcgaagttgtgcccacgctgcaccagctcgtccctcgaccacgccatgttgtcgcgcaggtagtcgaaaccgaactcgttgttggtgccgtacgtgatgtcgcactggtaggccgcgcggtgctcggcggccggccggttcggcaggatcacgccgacggtgaggccgaggaacacgtgcacccgaccgacccactcggcgtcccgctgggcgaggtagtcgttcaccgtgatgatgtgcacgccgtcgccgctcagggcgttcaggtatgccgggaacacgccggtcagggtcttgccctcaccggtcttcatctccgggatgttgccgaagtgcagcgcggcgccgcccatcagctggacgtcgtacgcccgctggccgagcacgcgcttggcaccctcgcgggccaccgcgaacgcctccggaagcagcgagtcgagcgactcgccgtcctgataccgctgcttgaactgctcggtgcactcgcgcaactcgtcgtcggtgaggtcgacgtagtcatcctcgatcgagttgaccgcgtccgcgatcgccttgagccggcgtaccatgcggccttcgccggcacggaggatcttttccaatatcgacacgggtcagcgctcccctagacagtctgccgaaccatcgtaggcaccttcttccggagcctgtgacccgagcctcccgccaatctcgcaaacaggacgaaacggggcaggaagttcgctgacagcgcagtccatgaccgtttgaagccggtttctcgcccgggcgagtctgcggcaggatggaggagtggatcacgacgacggggtgctgctgcgcgcccgcggcccgcaggacgaggccgcggtcacggcggcccgcgaggaccggcacggccggcggttcctgccccgcggcgggtcttcgaccagcgatttctcgtacgccgtcatccgcctcagcaccgggttcccggtcggcggcatcgatctggaccggcagcgggccgatccgggcgccgcccgggtcaccttctggatcgggtcgccggcccggggcctcgggctcgggaccgccgcgctgcgcaccctcggcgaccacattttcggcgacacgcccgaaatcaccggtctgcaccggctggagctgctgatccaccaggacaacccgatcgcccagcgggtcgcgctggcggccggcttcacgcgcgagggcgagcggcgcggcgccctgccgaacgacaccggcggctacgacgacgtgctcgtctacgcccggctggccggcgaccccgggacgcccgccgagcggctgctgcccgacctgcccggcggcgacctgaccgacggggtggtgacgctgcgcccactcggcgaggacgacatcgccttctacgccgacctgcacagccggccggacgtggtggcgaccagcgtgccgccgatcccgccggagccggacgaggtgcgccggcggtgcctctgggcgcccgcgcactggctggccggcagccgcgccgacatggtgatcgtggacaccgccaccggcgccccggccggcgaggtctcgctgtattaccaggagccgcggaccgggcaggcgatgatcggttacagcatgctgccggagttccgcgggcgcggcatgaccacccgggcggcgaaactggtcgcactctgggcgttcgccgagaccgggatcgcccggctgatcgccggcacactgccggacaaccgggggtcgcaacgggtgctggagaaggccggcttccagcgggaagcatacctgcgctcccggctgccgggcccggccggcacccgccacgacgacgtccaattcgtgctgttcgccgaagacctgctggcgcaggtctccggcggggaactcacacagccaggctgagaatcccgtagtcgtagcctcgacggcgatagacgacgctggggcggccgctctccttgtcgtggaacagatagaagtcgtgcccgacgagttccatctggaagagcgcgtcgtcgacggtcatcggctcgccggagtgctccttctcccggacgatccgccacggctggccgtcgtcgtgctcggtcagctcgtcgacctcgggctcggcggtcagcgtggcggcgccgccccgggtcagatcggtgggcaggttcgcggtggcggcggcgaccgagaccggtgcatgccgtccgcggtggacgcggcgccggtcggcggaacggcgcaaccgggcgtccagtttgttgatggcgcagtccagagctgcgtagaaatcctgtgcctgagcctcggcgcggaccaccggtcccttggtcatgacggtgatctcgacgcgctggcaggtgtccgactggcgcggattgcgctcgtggaacagctccacgtcgacccgcatcagcttctggtcgtaccgctcgaccttgctcagcttgtcggcgacatgctctcgatagtggtcgggaacctctacgttgcggcccttgacgacaatgtccactcgtgacctcccccaacgtgtaattcatggggcgccggatgccggcgcagggtgatgcttgagaaagacgccgcgagcttggaagaagagcaccgcggcaacgtgggtgagacgactcctttccggtacggcggaaagcgcagctcccggcgggcgggtaagttgatgaaccctaccctcgtcacctagacgctaacctgccgatccctgcgagtcacccctcgttggggataccggatggctgacgttcgcctctatcggcaaacgatcgcgtggtgacagtcaaatcccgggacaggatcggcgaagttgtgtagctgccagtaccgcggcgcccgtgacctgcatgcccgcctcctctagacgacgtaccgcggcggccagcgtggccccggtggtgacgatgtcgtcggctaccaccagcgtgcctcgcatcgcgtcgccgcgtcgcagaacgccgattcgggcgggattgattcgcagggaattgacagccgccgtggaccttgcggcagggcccagtgacgtggagtcagggcggggcagcgcggtcagcggctggacgaccgcgaccgtccagccggccgcccgcaaccggttcgccgcgtgcccggccaggcgcgccatgtggtcgccgtagcggtcccggcgggccgcccgggtggacggcaccggaacgagcaggaccggccggccccggggcgccagcggggcgaccgcgccggccagcagggcgccgagcgggctagctagctagcgcagggttccggcgtacgggccgaccgccacgcagggcgggaagccgggcgggggcgggctcggggcacaggcgtagggggccagcgcctccagctcggtcacacaggccgggcaggcgccccggcgcagccgggtgcgctcgaccccgcagccggcgcaggaccccggcagcaccagatcggccagatcggccaggaccgggctcacccggtcactccaggtagaagggcgcggtcggcgtcttgtccggcgccgcgcccgacgacgggaggccgctgagccggtccacaccgatcagggtcgccttggagagcagctcccatgccttgccgccggcggtgtaggacacccatcgcgagcggctgaggatcgtcggattggccgggtacacgctgatcgcgtcgaccggctgctcgccgaggtcgggaccggcgctggagctgaacgcgccgtcgatcgacatgtcgatgatcgtggcccgcttgtcggacgcccggggaccggccaccgacagccagccctcgctgctgaagccgaccgcggtcaccgcgtccaggccgaccggccggatctgctgcggggagccgagcgccggagtgtccccgccggtggtcagcgaggcgcggtagagcttgccgtcgaccaccagcaccacccggcgaccgtccggcgccaccgcgaccgcggtgatccgggtgccctgcccggtccacgggatcagctgcgcctctcccttgaccgcggagaacgagtagaggcggccgcccgccgggatcagcccgatcgcaccctcggccacgtcgtcccggtaggtgatcgcccaggccggctgaccgagcgggcccggcattccgctgatcggctgcagcgcggcctgcgccccggtctccgcggaggccacctgcagggtgtcgcccttgccggccaccacggcggcgaacacgtgcgagccggaggagctcatcgcggcggcgcggatgtccttgttgtcctccggccgcagcaccggcacctggtccggggtgttggccgcgccggtcacccggtggatccggccgtcgtacaccacgaacttgtccgggttgtcggggaccaaccggtacgccggattgctcgccaggtagtcgccgccggtgtacgacccgacgtccttgaagctgatcttgatatccagctcgccgccgtccggcagcagcggccgcagcgaccactgcagctgtttgcgcagccggtccagcgccagcgcggtgtcggtggccggcagcgacttctcgttcagcgtgatctgcagcctggtgccgttgatcgcgggcaccaccttgccgatcaggccgaagccgtcggccaggtcggacaccgacagccaggaggccggaccgttcgccatccagttcaggatcgtggtgggccgctgctcgaccggcaccgcgttcggcatgtagcgcacgtccgggaccagggcggtgtagtcggtgttccagaagtagatggcgtgctcgcggtagtagacgctcagcgcgtcggtgctgatcagcaggttcggcggggcgtccttgacgaacagcccgtcctggccgcccaccggaccgacccggaatcggtagacgtcggtgcggctctccgcctccggggtcagcaggccgaacttgtccagcgtgccgaccgtctgatatttcacctcgaccacctcgctgcccggggtgggcagtggcggctggaccagccggatcaccttcagaccggtcgtgttgggtttgaaggcggtcgccgcgtcgcgggacatgaaggcgcgcaaccggtcggtcgcggtgtccagatcgccggacgcggccttcagatagttctccacgaaggccgcgtggtcggtggactcgcttccccgggtgacctgggtcgagccgccgtagtcgccggggttgatgcccgccgacgggccgggcccgaccacggtcacgcccgagtcgtccggaatcccgcaggatccggtcaccagcaccgccagcaggccggccagcggcagcgcgatcaggcggcgagacatcaggacacctccgccgtacggtcccgggggatcagtggcagcggagccgccaccagccggtcgccaccgcggaccggcagggtgagccggaactgggcgccctcgccgggggcaccccacgcctccagccagccgccgtgcagccgggcgtcctcggcgctgatcgacaggcccagaccggtgccgccggtctgccgggcccgggacgggtcggcccgccagaaccggttgaagaccaggcgctcctcccccgccttcaacccgatgccgtggtcccgcacggtgatcgcgaccgccgcgtcgtcggtggccatggtgatctgcacgggcttggcctcgccgtgctcgaccgcgttgccgaccaggttgcgcagcacccgctcgacccgccgtggatccacctcggcgatcaccgggccgtccgggaggtgcagctccagctcgacgccgacccgctcggccagaccggccagccgctcggtgacccgctccacgatcggcaccaggtcggtgtgctcggcatccagcgcggcgaacccggcgtcgaagcggctgatctccagcagatcggtgagcaggccctcgaaccggtccagctcggcctgcagcagctcggcgctgcgcgccacggccgggtcgaagtcctcccgctcggagaagatcaggtcggcggccatccgcacggtggtcagcggggtgcgcagctcgtgcgagacgtcggaggtgaaccggcgctgcagccgggacatctcctccagccggacgatctgccgctgcaggttggccgccatctggttgaacgcggcggcgagcagggccaggtcgtcctcgccgtccaccttcatccgctggtcgagcaggccggccgagagccgctgggcggtccgcgcggcgacccggaccggggtgaccaccagccgggtgaccaggccggccaccacacccagcaggatcaccagggccaggccggtgaccagcacggtgttgcggatctggttggcggcccggtcctcggtggtcagcggcaccgcgtagtacagctcgacgtgaccgaacttcgacgtcaccggggagccgtagaccaggaacttggtcggccggcccttcacgtcgacggtgcggatctgctgggccacccggccgttggtggcgacctcggtgatcagtttcggggtgatcagcgaacgggtgtcggtggccggcggcacggtctgcgggacgatctccgggtaggactcggcgcggatcgacaccaccgtgccgctgtcgccggcctggtcaccgtcgtacagctcggtgacggtctcgctgatcgtggccggcagctccgggtcgtagggctgcgggtgcacggtcagctgctcggacgcgtagcgcaccttgcgctgcagggacgcggagacctcgtcctgcgcgcggttcaacaggatcttggcgctgcggtccgcgatgaaccagccgaacgtgccgaccagcaggctggacgcgacgagcgtcagggtgaccacgcggacctgcagcgagcggcgccaggagcggcgcaccggcgcggtataccgctccagccggtgcgcgaccacgcgccaggaacgccgcatcacccgaagggggcggcgcacgggttggggaagccaggccggagcacgcataacgcggcaacagtagccgcccggaccgcctagccggtgcccgccttgtagccgacaccccggaccgtcaggatgatctccggtcgctccggatccggctcgatcttcgcccggagccgctgcacgtggacgttgaccagtcgggtgtccgcggcgtgccgataaccccagacctgctccagcagcacctcgcgggtgaacacctggcgcggcttgcgggccagggccaccagcaggtcgaactcgagcggcgtgagcttgacctcctcgccgtcccgggacacggtgtgcgccggcacgtcgatggttatctggttgccgggcggcccgatggtgagcatctcgggcgccgcgtcctcgccccggcgcaaccgggcccgcatccgggcgaccagctccttgggcttgaacggtttcaccacgtagtcgtcggcgccggactccaggccgagcaccacgtccacggtgtcgctcttggcggtgagcatgacgatcggaatgccggactcggcacggatcgcgcgcgcgacgtcgatgccgctcatcccggggagcatcagatccagcagaacgatgtccgggcgattctcccggaaagcggcgagcgcgcgttcgccgtccgccacgaacgagggcaggaatccctcactgcgcaggacgatgccgagcatctcggccaacgcgggatcgtcgtcgacgaccagtacccgggctctcatgcggtccaatattgcactgtcctcccggcccccgcgctacccggggggcgatcttgcccggcagcctacgcgaaaagccaccacgtccagaaggcataagggcccggaaacccgcggtgaagacatgaaaacgggcggtcccggtccgggaccgcccgtggcgcgctcattcgagatatcgagcgttacgcgccgggccggtcgaactgtccggcacggaccccggcgaggaagccggtccagtcctgagcgtcgaaggtcagcaccgggccggtggcgtccttggaatcgcgcaccagaaccgccgccgccgtgttggcgacctcgacgcaatgcccagcagcgccactccggctgctcttacgccaagtgatcgtggcgtcctgcatggtttctccccttccctggaaaatgcatctccattggaacccaacgcaggcgctcaacgagccaaacgatccctcgtctcagcgatgaccgttcggctcgcttctttcgacaaagcgcgttcgtgcaggtcatcaaaggcatcgcggtagaccaggagctcctccggcttcacccggaagtgaccaccggtcagcccttcggagtgcacgaccgggttacgggtgccgtccggaaactccagcaccaggaacgattcggtgaggccggcgtgcgcgcccgcctcgaacggcaggatcaacacctccacgccgggttgctcggtcgcctcgtacagccgggtgagctggcgggccaggacgtcgcggccgccgacctcgcgcagcagcaccccctcgtcgagaaccacccgcagggtggcgggtggttcccgggtgaagacgcgctgccggtccatccgcacggcgacccggcgctcgatcacctcgccgtcctcgatgccggccccggtctcgatcaccgcctgggcgtactcctcggtctgcagcaggcccggcatcacctgggcctcccactgggagatcgagatggcttcgccctccagggcgagatattcgtcgtacgggtcggtgacgaacgagcggtacgacgtccaccagacccgggcgcggccgcgccgggacaggtcacgcagccggccccggtcctcgacccgcaggccgtagagcgtgagcagacggtccaggtccggctcggagatgccggtgtgcgcggtctcgatccggctcagcttcgactcggaccagcccagcgcggtagccacatccaccgcccggcgctccccacggagccggcgcaattcaccgccgagttcccggcgcgctgtcgatgtcggcctcgccacggagtcaccatatcggcgcatcaatagtcgattgcaacttgcaatgcgggtcacaggggaaagcgcgccacttgtccgttccggtcggcgcccggcggccgtgaattcccggcgatgacggcggtcgctgggtgctgacggctgccacctttcccggactagtcgcaggtagaaggcctgccggaggccggaagcggggaccggcggggcgaaaggcgccggtcagcggggcgggcgggatggccgatcccgccgatcgggcatcatccgtacaggtgaccagtcggtagggtgacggccgggcgtgtccgggtgacggcttccgctggttcgtcaggcggcgtccggcttgggcgggtttctccggtcgacggatccatcaacgatcgcggcgcgtcgacgggcacccccgccgtcggcgcggcggccggcgcaccgtttgtcgcagcagttgccaaacgtcccgcaaagcgcttcggccccatttccggcgatcctgcggaactgctcccgcccggcggcgggaatgaggcgggaatcaccggtcgcagcgacccggaacacacagcgggtgcggcggaaaagggtccggaatagcgaacggggcgacaggtcgaaacccgccgccccgttcatccccccggtttggtaccgcgcgcgtccgtgggaccccccgatcaccaatgacgctgcgtggttatagatttacactccgcacatcccatgtcaaggcatttgccgaaatttcgggcatgtgcgatccaagttttcccagctagcggcgacgggagcggcgtcagtccgggacggcggcgatgaagagggtcccgagaccggcagccgtcagctgacccgcgccggccggcgcgtaggcggccgcccccggccccaggctcaccggaatcccgtgatcctcgccgacgtgcacgtccccggccacgccgagcaggatccgcggccccgcaccgggcagtttcaccggcggccggttcccggtcagctccacccggtacatctcgaagtcgcggaccggcacccgccacgacgtcaccccgggcgccacctccgcgccgtgcagcagcgggtcctccagggtgtcgaaacgtagcaccttgagcagctcggtcacgtcgacgcgtttcggcgtgaggccgccgcggagcacgttgtcgctggccgccatcaactcgacgccgagcccgtgcaggtaggcgtgcaggttgccggccggcatccagatcgcctcgccgggcgccaggtgcacctggttcagcagcagcgccaccagcacgccggggtcgcccgggtagtgggcggccaggtcgatcgccagccggtacgactcggcgtacggctcggtgtcaccccgcgcggccgccgcggccaccaccgcgtcgatcagagcgccccggtcctcccctggccagctgagcagcagccggaccgcctcggacaggtcaccggcgcgcagcgccgccaccaccggctccagccggggcatctgcagcccggccagcacctgggccgacaccaccgccggccggaagccgcagagcgcgtcgaacggcgtcagcgcgaccagtatctccggcttgtggttggcgtcggtgtaattcttcggcagggacgggtcggcctcctgacgggcgaacgcctcggccgcgtatttcaggtcggggtgcgcctgcagcgacagcggggcgccggccgccagcaccttcatcaggtagggcaggcggtgcccgaagcgttcggcgacgccggcgccgagctgaccggccgggtcggtgtcgatcagcgcggtgagggtgaccggcccgtccgggcccggcacggtggacgggtcgcccgggtgcgcgccgagccacagttccgcctccggcccctcggtgggggtgggacggccctgcagctcggcgatcgcggtcttggagccccaggcatacggccggatgactccggtcagcgggtacacggtcatacccggcaaattagcagttgttgtcaggcggtgacgggtggtgcggaggtcaccgcgtcatcggcgatctcccgcggccggtagatgtccggctcgatgtagatcacccgggcgatcggcaccgcctcacgaatccgcacctcggtctcgtcgatgtgccgggccacctcggccgccgtctccgaccgcggcaccgcgatcttcagcgcgaccagcagctcctccgggccgaggtgcaacgtcttcatgtggatgatccgctcgacgccgtcgccggcgagcaccgcccgctcgatcctgcggatcgcctccgggttggcgccctcgccgagcagcaggctcttggtctcgaccgccagcaccccggcgatgaccaccagcaggacgccgatcgccccggtgccgatcccgtcccaccggccgttgccggtgatcagggtcatcccgacgccgaacagcgccagcaccagaccgaccagggcgccggcgtcctccaggagcaccaccggcagctccggggccttggcccggcggatgtagtcgatccacgaggtggtgccccgggtccggttcgactcggtgatcgcggtccagaaggaatagccctccagcccgatcgccaccaccaggaccacgatcggcacccactgccagctgtcgatcttctgcgggtgctggatcttgtgccatgcctcgtagagcgcgaagaggccaccgacgctgaacagcacgatcgagacgatgaacgcgtagatgtagcgctcccgcccgtacccgaaggggtgctcgggggtggccttcttctccgagcgcttgcccccgatcagcagcagcagctggttgccggagtcggcgaccgagtggatcgcctcggcgagcatcgacgacgagccggtgagcagccaggcaccgaacttggtgaccgcgatgcccaggttggcgctgagcgccgcgatgatcgctttggtgccgccctcggcgctcacgagagtccctctggcatcgggttggacagctccttcatctcgctgatggccggcaccgccatcgggtccaggccgtgggccagggccaggtagagcgacgcgaagtcgggcaccgcgaccagggacgcgagccgctccagggtcgaaccaccctcggcggtgagcacgtcgcagcgtacgccacggcgatcggcgagagtctggatggcgtccgcccggcgctcctcgacggcgaccggctcgtcggcgtcgtcctccgggttcagcccaccgtcgcggagcaccaccaggcgcagccgggtgaccgcctcgtcggcgtcctccgggtcggcgaagatgtcccgggagccctcggcgaggccaccgaagacgccgtcgagcaggccgacccggccccggccggcctcgcccagcgcaccggccatcaccgggtagcgcgcattcgcggcgagtgtgtcggcgaaccggcgggcggcgacggtggccagcggggaggagccccagacgatcggcaccgagccggccaggccgagagccagcgccttggccgggttgacgaaggagtcggcgcccggacggcagcgctcggcgtccgcgtccagccgggtcgcggtctcggcgatgtcggcctcggtgaccttgaccaggcccagcgcgcggccggccagcagcaccggcacggccaggccccagagggtggcgcgggccggggcgcggcgcggcacgccgatgaacggggcgcgggcccgctcggccatcgcctccagctcggagtcggggttgccgatggcgaccaggcgggcgccgcggcgggccgccgcctcggccgcggccagcgcctcggggctgcgcccggaggcggagacggcgatcaccacgtcggccgcgccgacccagccggggatgccggcgctgcggtgcccgatgatcggcaccgggcagcgcgggccggcgacggtggacaggatgttgccggtcagaccggcggtgccgatgccggcgaccacgacggcgcgcgggcggccctcgtcggccagcatggtcaggtcgacctcggcggccagcgccgcggtctcccggacctgggcgccggccgacgcggtggcccgcagcatcccgcccgggtcgttgtccagcatcgacttctcgtcgttgagcagcgactcgtcggcgacccggtgcccgttgaccccggccgaaccctccagcggattgaccatcactgatcccccttctcaacaacacgagcttcgtcgagaaggaggatcgggatgtcgtccttgatgtcgaagatccgcccgcactcggtgcacgtcaatgtctgcccgccggcgtcgtagtccagtggcgcgtgatgggtgtccgggcaggccaggatgtccagcaactgcggatcgagcgccaccgagctactcctttggtacaggcggaagcgtgtccccgcgatcctatccgcgaacgatggcgagcacgcgatccctgagcgacgccatcgtcgaggcgtccggcgcctccacgttcagccgcagcagcggctcggtgttggacgcccgcaggttgaaccacgacccgtcctcgaacccgaaggtcagtccgtccagatcgtccacctgggcgtccgggaacgcggcgcgcacctcggcactcttggcggccgcgtcggccaccgtggagttgatctcaccggacgcgacgtaccgctcgtactccgcggcgaactcggacagcggcaggtcctggccgccgagcgcggccagcacgtgcatcgcggccagcatgccggtgtcggcgaaccagaagtcgcggaagtagtagtgcgccgagtgctcgccgccgaagaccgcgttggactgcgccatctcggccttgatgaacgagtggccgacccggctgcgcaccggcttgccgccgttctccaggatgatctccggcaccgcggccgaggtgatcaggttgtggatgatcgtgctgttcgggaacttggccagctcacgggcggccaccagcccggtgatggcggacggcgagaccgggtcgccgttctcgtcgacgacgaaacagcggtccgcgtcgccgtcgaaggccaggccgatgtcggcgccctgctcgcgcaccgcggcctgcaggtcgaccaggttcttcgggtcgagcgggttggcctcgtggttggggaaggagccgtccagctcgaagaagagcggcacgatggtcagcggcagcgggctgagcacctggtcgccgaggacggccggcacggtgtagccgcccatcccgttaccggcgtccacgatcaccttgagcggacggatgccgctcaggtcgaccagcgagcgcaggtgcgcggcgtagtcgccgagcaggtcccggtgctcgacccgggccgggccgtcggcctccgcgttcaggtcggcgagcagttcctgggcacgcacccggaccacgaccaggccgctgtcctggccgaccgggcgggcaccggcccggcacagcttgatcccgttgtactgcgcggggttgtggctggcggtgaacatcgcgccgggcaggcccagcgagccggaggcgtagtacagctggtcggtggaggccagcccgatgttgagcacgccggcaccggccgcgttcaccccgcgggcgaacgcggcggccagcccgggaccggactcgcgcatgtcgtgcgccaccacgatccgttccggctcgtcaccggactcccgcagcatctcgacgaaggcggtgccgatcgcccgggccaccggctcgttgaactggtccgggacgacgccccggacgtcgtacgccttgatgatctgggacagatcgagcactacgctcactcctcacgaaagccctgttgaggctgaggctagcggagcgcggacaccggcaaggttttatccccacgaccacaccgttaacggacgagatcacggcaggcccggtcggcggcccgggtggtctccggcagccggtaccgggcggccagccgcagcgtcaacgagcaggcgttgtccagatcgatgcggtgcccggcggacacgaacaccggcttcaccccggactgcgtgcgcagcaccgcgccgaccgtctcacccgcgtcgaccagcgccgagcggctcccccgcgactcgccgagcggcgcccactcacccacaagacgggtcttgccgaccccgaacgagggaagatcggtcagcacgccgaggtgcgaggcgagcccgaaccggcgcggatgcgccagcccgggaccgtcacagatcagcacgtccgggcgcacggtcagcttctccagcgcggccatcagggcggggacttcgcggaaggcgaacaggcccgggacgtacgggaaagtggtctggcctttgatcagcgcgacgtcgcggaccgcgaggtccgccgtgccgagcacgacgacggccgcgccgagccggtcaccgtcgtaggcgacgtcgaggccggcgacggtctccggggacgccgggcccggcgcggcgacgacccgggcgcgcaggaggtcctggacggcgagagcttcttcttcggtacggggccaagggtgcacgaaggaactttagagaccgttgtctctgatcgtgatgggcgtcacgatggggggcggaggtgctgccggtgaatccgtggcttgccctgacccctggtgacgatccggccgagcggatccggcaggtggggcgcgcccacgagcggttcctggccgggcagcggcggccggagctgatgcgcgcggtggtggccgagtcctgggcccgatcggcggcctgggtcggagcggacagcacgccgccggtcgagctctgcgacgacgagctgcaggcgtatcgggccgcgcatccgctggcccgggtgatgccgatcttccgggatctgctgggcgggctggccgaggacggcgatcacatcctggccgtctgcgacgcgcacgggcggctgctctgggtggagggcaatgccgggacgctgcgcggggtggcgtcgatgaacttcgtgccgggcgcccgctgggacgaggcgcacgccggcaccaacgcgccggggaccgctctcgcggtcgaccacgcgctgcagatcttcgcgaccgagcacttcaaccggtcggtgcagcggtggacgtgcacggcggcgccgatccacgacccgggcaccgggcggctgctcggggcgatcgacgtgaccggcggcgaccacctggccaatccgcacagtctggcgctggtcagagccacggcgctggctgccgaggcgtacctgtacgagccgccgcgggcgacgagcggaccggcggtgacggcgctcggccgggatgaggcggtcctggtgtccgggaattcccggacgaagctcagccgccggcactccgagctgctgatcctgttggccgcccaccccgagggccgcaccggcgaccagctgaccctggacctctacggcgacgacctcaatccggtcaccgtccgggccgagatgtcccggctgcggcgcatcctcggcccggagctgctccgctcccgcccctaccgcctccagaagcccatgaagacggacttgggcgagatgtctgaagcactcgccggcggcaacctcgccgaagcactgaggaactaccccggccccctgctccccggctccgacgccccgggcatcgtccgcctgaggcgcctgctcgacgaccgcctcagaaccgccctgctgcactccgccgacccccacctgctgcgggaatggctgagcaccccgcacggcgccgacgacctggcgctgtgggaggcctatgccgtcctgacccccggcgacccgctcaccagccgccgcatcaccgagctctcccgcgaatacgcgtgcaacgtttctgcaacgtactcgtgactaacgtccgccccgaagaggaggcgagattcatgaccacgtatgttccgcccggctccgaaggcgcgatcgtcagctaccagtcccgttacgaccactacatcggcggcgaatacgttccgccggccaagggccagtacttcgagaatcccaccccggtcaccgggagtgcgttcaccgaggtcgcccgcggcaccgccgacgacgtcgagcgggccctggacgccgcgcacggcgccgccgacgcgtggggccgcacctcggtcgccgaacgcgccaccatcctcaaccggatcgccgaccggatcgagcagaatctggagaagctcgccgtcgccgaatcctgggagaacggcaaaccggtccgcgagacgctcgccgccgacctgccgctcgcggtcgaccacttccgctacttcgccggggcgatccgcgcccaggagggcaccgcgggccagatcgacgaggacaccgtggcgtaccacttccacgagccgctcggcgtggtcggtcagatcatcccgtggaacttcccgatcctgatggcggtctggaagctggcgcccgcgctggccgccggcaacaccgtggtgctcaaaccggccgagcagacccccgcctcgatccactacctgttctcgctgatcggcgacctgctcccggccggcgtggtgaacatcgtgaacggcttcggcgtcgaggccggcaaaccgctggccagctcgaaccgggtcgccaaggtggctttcaccggggagaccaccaccgggcggctgatcatgcagtacgcctcggagaacctgatcccggtgaccctggaactcggtggcaagagccccaacatcttcttcgacgacgtgagcggcgccgacgacgacttcttcgacaaggccctcgaaggcttcgcgatgttcgcgctcaaccagggcgaggtgtgcacctgcccgagccgcgcgctgatccagcagggtcactacgccgacttcctgtccgcgggcgtcaagcgggtcgagaacctgcggcagggcaacccgctggacaccgacacgatggtcggcgcgcaggcgtccaacgaccagttcgagaagatcctgtcgtacctcgacatcggccggaaagagggcgcgaaggcgctggtcggcggcgcgaaggcggacctcggcggcgacctgtccggcggcttctacatccagccgacgatcttcgagggccgcaacgcgatgcggatcttccaggaggagatcttcgggccggtggtctcggtgacgccgttcgccgacttcgacgacgcgatcaagatcgccaatgacacgttgtacgggttgggagccggcgtgtggacccgggacatcaaccgggcgtaccgggccggtcgggcgatcaaggccggccgggtctggaccaactgctaccacctgtacccggcgcacgccgcgttcggcggatacaagcagtccggaatcggccgggagaaccacaagatgatgctcgaccactatcagcagaccaagaatctgctcgtcagctactcccccaaggccatgggattcttctaggccatggcgacccgcgtcgacgtgactcccgcggccgccgccatgatgcggcggctgcgggagcagcacggcccactgatgttccaccagtccggcggctgctgcgacggcagttcaccgatgtgcttcccggagggtgaattccgcaccggcggcagcgacgtgctgctgcagtcgctggcgatcgagggggtgccggagccgatcacgttctggatgtcggccgcgcagttcgaactctggaaacacacccatctgacggtcgacgtggtgccggggcgcggcgccggcttctcgctggaagcgccggaaggcgtccgcttcctgatccgctcacgattgctgaccgacgcggagcaggaggagctgaaaacccgttgaggggtacgtcgagccgcacggacgggtgagcgggactgccccgccgcacgtccggatcgatactcataggacgagtctgcccgctttggagggttccgggactggacagcgtgcgcaaggatacgggctcgaacgccgaagagccttgatctggggaggaaacgatgcggctgtccagcacccggagagccctgctgatcagcatgtcgctgatcctggcgggtcttctcggccaggcggccgccgcggaatcgacacacagctcggcctccgccgcggcgcccgccgtctccgcgtcaccggtctccacccccacggtggcgactccaccggtggtgaagcccaccaaaccgcgcaccgagagcacccggattccggaacggcccaagggacacagcgggccggccggcagcctgctcaccaccggcagccgcggcgtcgccctgaccttcgacgacgggcccgacccggcgaacaccccggcgctgctgcgcatactcgccaagaatcacgtgaaggcgacgttctgcgtggtcggtgagaacgtcaaaaaccaccctgacatgatccgcaagatcgtggccggcgggcacgccctctgcaaccacacctgggatcacgacctcaagctcggcaagaagagcccggcggcgatccgggccgacatgcagaggaccaacgacgccatccgggccgcggtgccccaggcgcagatcaaatacttccgggcgcccggcggcaacttcacgccgcagatcgtgaaaatcgccaaggaactcgggatggcctcgatctactggaaggtcgacccgcgggactgggaacacggccgcgaggaatcggacggcgcgcacaccaaccgggtcatcaccacggtgaaaagccacaccgggccgggagcgatcgtgctgtcccacgactacgcccagccggacaccatccgggcgtacgccacgctcatcccgtggctgcgcagtcgcttccgcctcatcgccctgccgtgaccggaacggcggccctgcgggtcagtgggacgggggaatgacccgcaggtgaccgcggcggccggtctggtggcccggcggctgctccggcacatctggacgcggcgggggcgccgggcgggcggcctcgcggaccgcctcggccagagcgaccagatcgtcggtggtggggggcggcggggcgaaatcgccgtcgtgccggacgagctcccagcctcggggggcggtgaggctgcgggcgtgcggctcgcacaggtcgtacgtgtgcggctcggcgaacgccgccaacggcccgacgacagcggtcgaatcgctgtagacgtaggtcaaagtggcgaccgcctgtcggggacagccgttccgggagcagcgccgtggtgacctcacggcggcaacctatcgccccgccgggccttctggacagcgttgcctcgcgacacgccgcaccgcgatgcatcacgattcggccatggtcggccgacacgccgccccgatgggacgaattaacgggtcagacacacggtgcggaacgggctgaccacggatgtcgcccgggtggggatacgctcagcgtgtgaccaccagccccgaacgccgccgcaccgacccgaaagcggcgcgcagcaccggtccgggccatccggcgcgccgcgaccggcacgggcgcggcctgcgcggccgcctggtgccggcgaccgtgccgctcgcccgcaccaaggcggagatcttcgacgatctggtgctggacaccgtcgaaagcttggaacggcggtatgcgaaagagctggccggcgtcgagttcgcggtcgaggacgtgccgcccgagctgaacgtgtacgactcggacgtgctcgaggacggcgaggtgcccctggcccggctgctgcccggccgcccggggcggcacgagctgccgccgcggatcgtgctgtaccgccgcccgctggaattccgggcgatggaccgggaggacctcgccgacctcgtccacgacgtgatcatcgagcaggttgccaacctgctcggcgtcgacccggacgagctggcctgacgccgcgggccgctgcctcgcggccccgtggttcgcggtccggccctgcgcagccgcattccgcggccgccgtcttgggtcgtcttcctgccttgctgatcctgcccttgccggccctgctttccggggccggtcttgctctggtggccggtcgtgctttttcggccggtcttgctcagtcggccggtcgctgcgtctccccccgagacgccgcggccgtcgcgatcaggcgacgcgtcgcttcagcttgcgacgttcacgttcggacagtccaccccagatcccgaaccgctcgtcgtggccgagtgcgtactccagacattcggctttgacctcgcagcgaccgcagatgcgcttggcctcgcgcgtcgatccacccttctccgggaagaaggcctccggatcggtctgcgaacacagcgcccgctcctgccactcgggcgcgtccccaagcaggtctaccccttcaacctgcgcttccatcggcgtgcctccaatttctgcgccggcagcgatgccgacactgaccccccacgcacgcggcgtgtttctgtgggtacgacgcaaaagtcgcacatcgtccccacaaccccaccaaaattacacgcgtgtaagacgtgcgtcgtcaagccgaacctgataaataggcccgtttccccgccacaccggggcgcggcgcggtcccgttcctgccctatctcccggagccaccggaaggtaacgcgagcgtccgcccacacgtccaatttaacccgttttgttacctcccgtgaaggggggtcacgccacgggaccgccgccccctcccaccaggcaagacagtgcccctcaccgtccccgccgcgaaccggccgggccactcccccgccaccgcccggaagggacggtccacagccaccggaaccccaccgtggcgccgcggatgcccgccccagccaagatcgaaacccgccaccctcgtggcgctcaccacccgaccgcgggacccgcgaacccaccggctccgcagtcccggccgcgacgccgacagcccgaggcccggcccctccgaaaaggccagccaccagagatgacgcagcccatcagaaaggacgagccgccggaacggcccggctcaccacgaacaggccggctcaccacgagcggaccggctcaccacgagcgaccggctcaccacgagcggacccggctcaccaggaaaggccggccgttggagcgagccctcgcgccaccgcccgtcagagcgaggacaccggctccggcgcccagccgcccaccaccaggagcctcccgccaacccaaccggggaacgaagactgttggcgcgcggtcaacgagaacgacgagaggcagaaccgggtctacgcaccacccgccgatggctcgccataacggacgggccggaaaggcctaccggcgcgttggggtaggcagcggccttcgaggcgacacagcgaggcacggcatgtaggcaccacatgtaggcaccgcacgcaggcacgaccaagcacgcaggcaccgcacgtacggcgcaccgggcgcgaggtccgggacacctcgctgaaggttccgcacggcgagaccggcgcggtcatcgatgtccgcacgttcgcccgcaaggacggcgacgagctgcccccggcgtgaacgagctggtccgggtctacgtcgtgcagaagcggaaccgagctgaccccggaggagggcctgctgcgcgccatcttcggcgagaaggccggcctggaatgcggccgcgccggggcgtgcgccgaggccggagcggatggccgctccggccgtcggtcagcggcgggcgtacacggtggtgcgttcgacggcgggacggccggcggccgcggcgagttccttgagctcggcgacggtgcgggcggagccgtgttcggagccggccatccgggagatggtctcctccatcagggtgccgcccaggtcgttgcagccgctgttgagcatgatgcgggtgccctcgtcgccgagtttgacccaggagcactggatgttcgggatgcggccgtgcaggaggatgcgggccatggcgtggacgaccctgttctcccgccaggtggggccggggcgggcgatgccggccaggtagatcggcgcgttggtgtggatgaacggcagcgcgacgaactcggtgaaaccgccggtcacgtcctggatgccggccagcacccggaagtggcccagccactgacgggggtggtcgacgtgcccgtacatcatcgtggagctggagcggatgccgacctggtgcgcggtggtgaccacgtcgacccaggtggcggtggggagtttgcccttggtcagcacccagcgcacgtcgtcgtcgaggatctcggcggcggtgccggggatggtgccgaggccggcgtcgcgcagatcggtgagccactcccggagggagacaccggccttggcggcggcggtgacgatctccatcggcgaatacgcgtggacgtgcatgccggggacccgctgcttgaccgcgcggaccaggtccgcatatgccgtgaccggcatcttcgggtcgatgccgccctgcatgcagacctcggaggcaccgtcgcgccaggcctgctcggcgcggtcggcgacctgctcgacggagaggcggtaggcgtcggcgtccttctcccgctgggcgaacgcgcagaaccggcacccgacgtagcagacgttcgagaagttgatgttccggttcaccacgtaggtgatgtcgtcgccgttgacgtcgcggcgcaggtcgtcggcgatccgggcgatctcgtcgagcgccgggccgtcggcggtgaacagcgccatcgccgcgtcctcgtgctgcggcagcagcagcgccgccgggtcggtggaggcgagcttgagaccggcgagcaggtcggccggcacggtgcgggggacatccccggcgggcaccgaccgcggatcgctcccggcgggcgcggactgcggggtcctgaggtgggcggccacctcgtcccagtcgccgtagacggagtcgaagtcggagcggcggtcaccactgcggccctcggtgtcgatcgcggcgtgcaggtcggtgcgaccggtgccgaacgcctcgtccggctcctgccagggcaggccggcggggaacgcgtcctcgcgggccaggccggccgggtcggcgagcgcggtcacgtgtgcggccaggcgcgggtcgagccagccctcggcgccgcgccgcacatactccgggtagatcgtgaggcgctcgcgcagggtgaagccggacgccgcggatttctcggcgagcagcgagatctgcggccaggggcgctccgggttcacgtggtccggggtgaccggggagacgccaccccagtcgtcgatgccggcccgcagcagcagcgcgaactcgtcgtcgatcaggttgggcggggcctggacacgggcccgcgggcccatgatgatccggccgacggcgaccgtggcggccagctcgcgcagctcggcgtcgggcatcccgcgcatcgccgtgtccggcttggcgcggaaattctgaatgatgatctcctggatgtgcccgaactcgcgcgcggtgcggcggatcgcgaacagcgactcggcgcgctcggccggcgtctcgccgatgccgatcaggatgccggtggtgaacggcacgccgacccggccggcgtcgtcgagcacccggagccggaccgcgggctccttgtcgggcgaaccgtagtgtgggccgccgggctcggaccagagccgggtggcggtggtctccagcatcatccccatgctcggcgcgaccggcttgagccgctgcagctcggcccagctcatcacgcccgggttgaggtgtggcagcagaccggtctcctccagcaccgcgatggcgcaggcccgcacatagtcgagggtggagtcgtagccccgctcgtcgagccactgccgggcggccggccagcgctcctcgggccggtcgccgagcgtgaacagcgcctccttgcagccctgggcggcaccctgccgggcgatctccaatacctcgtcgcgctccaggaacgcggccggcaggcggtgcggcacggtggcgaacgtgcagtagtgacatcggtcctgacagagccgggtgagtgggatgaagacctttttcgagtacgtcacgacaccgggccgtccggcctcccgcaggcccgcgtcccggatgccgccggcgatcgtcagcagctcgtcgaactgctcgccggtcgccgccaacagcgcggtcgcctcgtcgacgtcgatcgccttgccgtcggcggcccggcgcagcgcccgccggatgctcgcctcggtgggcgcggccacatcggccgccgcaaccgcgccgggcgccgaacccgaaccggccaccgcaaccgagccgggcaccgcgaccgaaccgggctccgcaccggagccgagcgccggaaggaagacgggcgccggaaggaaaacggcggccgcaccggacccggccgtcgcgctggaaccggctgccgccactgctgaggaaacgccctcgttgacctctgccacgaaaacaacctagaccggaatcgttccggttgccgccgtcgtccacaggcccgcgaagtgtcgtgtgacactgcccggccctgtggacgaccggcgattactgtcggggcgggtcggcgtcggccggcccgaagccgggacgctcctccggcagcacgctggtgcggtcgatcggctccggttcgccgcgcggcaccacctgggtgggctcggccaacggcggcggggcgaccggcggtgcgaccaccggcggctgattccaggccggcggctgagcctgcgacgcgaccggcggctgagtccgcgagacgaccggcggcgccggcggcggaaccggctgagcgtgcggcggctgcggctgcggcggctgaccataggtgcccggcgggtaggacggcgcctgtccgtagatccccgaagccggataggccgccggctgcccgtaaggctgcccgtacgactgcggctgcccgtacacccccggcggcatctgcggtttcggcaccatgtagacgccccgccagatctgcagcaccgcgtaccccgccacgccgaacaccgccagccaggcgacccgggcgaggagcgcgctgaaggccgcccccgcgtcgtacgacgcgatgttgatcacaccgaacagcaggccgaagatcaccccgaagaacgccatcaccgcgtactcgatgaccgcggccagcgtgatcagccgggctctggggtggaccggcttgatgccgagcgccagcagcaccgcggccagcggcatgccgatcgtctccaggctgatgaacccgccgaagctggccgccgcgcgagcgccgaagccgtcgccgaacaggttcagcacggtggcgaggaggaacacggccggggcgccgaccaagacgtacgcggcgaggtcacgcagcggcgtcaggtactggccgatcggtttgccctcaggcggtgcactggtcacggtaactcccggacgtacggtgatcgaggaacgcccagagtaaaccgcgacccggcaaccggccgggcgacgcgggtgggagaggatgggctgatgcggatcgtggtcctcaccgggggtatcggcggcgcccggttcctcgtcggcgtgcgtcagcacgcccgtgccatcggcgccgaggtcacagcggtggtcaacgtcggcgacgacgtccggatgcacgggctgcagatctgcccggatctggacagcgtgatgtacacgctgggcggggcggccgacccggagcgcggctggggccgggtcggcgagagctgggtcgtcaaggaggaactggcgaaatacggcgtcgagccgtcctggttcggcctcggcgacaaagacaccgccacccacctggtgcgcaccacgatgctgaccgccggatacccgctctcccaggtcaccgccgcgttgtgtgagcgctggcagcccgggatcacgatgctgccggccaccgacgaccggctggagacgcacgtggtcgtcgatgtcgacggcgagcgcaaggcgatccacttccaggagtggtgggtgcgctaccgcggggcggtgccgacccaccggttcatcttcgtcggcgcggagaaggcgaggccggcggccggggtgctggacgcgatcggcgcggccgatgtgatcctgatcgccccgagcaacccggtggtcagcatcgcgccgatcctggccgtgccggagctgcgcgaggcggtgatcggcgcggcggcgccggtggtcggggtctcaccgatcatcggaggttcacccgtccggggtatggccgacaggtgcctggccaccctggaggtggaggtgagcgcggccggcgtcggccggatgtacgggccgcgcgccgagggcgggctgctcgacggctggctggtcgacacctcggacgcgggcgtcgagatccccggcgtggtgacccgcgcggtgccgctgtggatgaaggacgagaccctcaccgcgcagatggtcgcggacgcgctggagctggcccgatgaggctggaggtgctgccggtcgaggggatcggcgacgtcaccgccggcgacgacctggccgagctgatcacccgggcggcaccctggctggccgacggcgacgtgctggtggtgaccagcaagatcgtgtcgaaggcggagggccggctggtcgaggtgccggccgacgagccggagcgggacgaggcgcgggcccgggtgctggtggcggagaccgcccgggtggtggcccgtcgcgggccgaccaccatcgtgcagacgcatcacgggttcgtgatggccgcggccggcatcgacgcgtcgaacgtggacaagacgcacctggtgctgctgccggccgacccggacgcgtcggcccgccggttgcgcgccgatctcgccgcgcgggggctggacgtggcggtggtcatctcggacacgatgggccgggcgtggcgcaacgggctcaccgacgtggcgctgggtgccgccgggatcgaggcgcttctcgaccatcggggcgagatcgacccgtacggcaatgagttgaacttgacgcagatggccgtcgtcgacgagctgtcggccgcggcggagctggtcaagggcaagtgtgaccaggtgccggtggcggtggtgcgcggctatccgatccggccggacacgaccggcgccggagcctcggtgctgatccgcgacggcgagagcgacatgttccggctgggcaccgcggaggcccgggcggaggggctgcgggcggccgcgctgatcgccgacggcgccggcccggagcccggcccggagccgctcgcgcgggtactggagctggtcggcgccgtggtgacgcccggcatcgggatcgtcggtgggacgcggtcgctgcgactcaccccggccggtccggcgccggccgatctgctgcgcctcggcgccgacgcccaccggatccgcgcggccttcgccgccgagggcctgaccacccgcgccgagttcgacgacgacggtgtgacgatcaacttcggagaatcatgagtttgtacgaggatgccgtccgcgtcctgaccggctggccggccacctccgacgtggccgaggtgaaccgcaagcgcaccctcggcctgctcgccgacggtccggtggcgatgacccgggcgcaccgggccgggcacgtcacagccagcgcgctgatcgtcgacgacgccggccgggtgctgctctgcctgcacggccggctcgggctgtggatgcagctcggcgggcactgcgaggacggcgacgcgaccctggcggccgcggcactgcgcgaggcgaccgaggagtccggcatcgacggcctgctcctcgacccggagccgatcgacatcgacatccacgaggtgcgctgcggcgcgacggacggcgctccggccgaggcttcgatccattacgacgtacgttttctgctgcgcgcgccggccggagccgtggagcggatcagcgcggagtcgtccgacctggcctggttcgcgccggacgcgctgcccagcccgctcgcctcgggcgtcgtccagcagatcggtccggcgcaggcccggctgggctgaaccggctctccgccggcgccccggccgggtgatctcctccccgattcgtgccggtgcgtgaaccgcttcagcacgggtcactgtggtcggccaggatggtccccgtcgaccgaccgagagacctggtgagaaccgaaatgcgcgacctccgcacccgcgccctctgcgccgccgccgccgccctgctcgtgctcggctcggtaaccggctgttccgggaccgccgagccggccgccccgaccgccggcaccactgcgagcagcgccggcggaaccaccggaaacgccgcaaccgccggcacgggcaggaccacggccgcccacccggtgaccgcgaagaagccggccgcctgccacgacgcggacctcgccatcacgatcaccgcacagccggacgacccgggcaccggcgccaccctgcgcgccatggtcaccctgaccaacaagagcaggcacacctgcaccctgaacggctggccgtcggtcgcgccgtacgacatggccggcgaagtgatcaaagtggcgaccgtgcgcaaggtggcccaacccggcccggtcgcgccgttcaccgtcgacccgggcgtctccgccttcgccgggctcaagtgggccacctgcggcgacgacgagaactgcggctggggcaacgcgctgcgggccagcgtgcaggggccggccacccagggtcagtgggcggaactggagggtttcggcgacgccgagcacaacaacatccggatcaagtcactgcagatcggcacgctgcagccgagccaccagggcgtcgtcgcctggtgacccggccgtgctcgccggcgtccaccggcgggccggcatccgtcccggctcagatgtagccgtgctgacccagctccttgagctggtcgaccaggtgcttgacctcctgcgcgcgctcccgcgggcagatcagcacggcgtccgcggtgtcgacgatgacgagatcgcggacgcccatcgcggccaccagccgccccgacccgggcaccaccaccaggttctcggtgtcccgcagcagcaccgtggggcgttcgccgtcccgctcgtggccgaccaccacgttgccggccgggtcggcggtcagcacctcgcccagggtgtggaagtcaccgacgtcgttccacccgaagtcaccggggacggtggcgacccggccgacggtggccgcgccctccatcaccgcgtaatccaccgagatgcgtggcagggtcggccacacctcgccgagcacctcctcctgctcggcggtgccccacgcctgggcgatccggctcaccccggcggccagctgcggttgctggcgggcgagctcggccaggaacacgtcgacccgccagacgaacatcccggcgttccacagatagttcccggatttcacgtacgactcggcgacgtcgtacgacggcttctccttgaactcctcgacctgcagcaccgggccgtcctcgtgcagctcgccgccgcactgcaggtagccgtacccggtctccgggcgggtcggggtgatgccgagcgtcatcagcaggccgtcccgggcaccgaccatcgccttacggatcacgctggtgaactcggccttgtcggcgatcaggtggtcggacgcgaacgagcccatgatcgcttcgggttcgcgccgggcgatcaccgcggcggccagcgcgatcgccgcacaggagtcccgcggcgacggctcgaccagcacgttctcgtcgggcatcgcggtgagctggcgggagaccgcggccgcgtgggccaccccggtgacgacgaacaccttgtcgggcgtggtcagcgtgtccagccggtcgaccgtggcctgcagcagggaggcctcggtgccggtcagggggtgcaggaacttgggatgaccggcgcgggacagtggccatagccgggttccggtgccacccgccagaaccactccgtacagcgcactctgttcgtcgctcatggcgcggagtttagtagaggctcagttcgcaacccgattccacgttgttacatgcacctccgcgctggacgcccaggtgaattctttcgcccgatcgaaccccgctttggcaagcgcctgtcgtcgctgctcatcgtgcatcaggtcggccagatcctcggcgatccgctccggtgcctcggtcgtgtaggcgaccgcgtcaccgcccacttcgggcagcgacagccgcggagtggtcagcaccggggcgccgcaggccatcgcctccaggatcggcaggccgaaaccctcaccgaacgagggatagcaggcgaccagcgcgccacccaggaaaccgggcaggtcggcgtagcgcaggtagccggggcgcagcagccgcaggtgcgacgggacctcggcgaccgcccggtcgatgtcgtcgtcgtggccctggccgccggcgatcaccagggccggcgggcgcggccagtcggcgaccgcgcgggcccagccacggatcaggttcggcacgttcttccgcggctccttggcgccgaggaaggcgacgtagccggcgtcacccaggccgaggcgggcccggacacgggccttctcctcctcggtcggcatgtggaaggcggcctggtcgacgccgtgatacgccacgtcgatcttggtggggtcggcgtcgagcagacggatcagctcgtcccgggtggccttgctgggcacgatcacccgggcggcccggcgcagcgacgtcttgatcgcgctgcggaagaaggtccgcttggtgttgtcgtagtgctccggctcggtgaagaaggtcgcgtcgtgcacggtcaccgtgaccggggcgccggtccgcagcgggcacgtgtagaacggcgagtgcagcacgtgggcgccgacctgctgggcgagcagcggcaggccggtctgctcccaggccagccgggccggccggtgcgcgatcgccgccggaccgggcagcacctgtgcctccggcagcatccggcggtaacgctccgcatccgaacgctgggcgacaacggccaggtccacacgttccgggcccagctgcccgagggcgccgagcaatccgtcgacatatctgccgactccacctctgtccgcggggacactagtggcgtcgaccagcactcgcggggggcgaccgggggtcacgaggcatctccttggcggtttcgacgtaccgatgctgcggtggggcatggacgccccggggtggcggcgtccctcccgagactacgccgggaatgcttccggagagtgtccgcgacgccggtggttgccgtacgttgccgtaatcgacgccggaaagacgcaccgatgcgatcactctgagtgacgacctagggttggggacgatgaacaccacgattccgcaggcgttcgcggaggcggtccggcgggacccggccgcacccctgctcacctggtatgacgacgccaccggcgaccgtgccgaactctccggcgccaccctggacaactgggtgtccaaaacggcgaacctgctggtcgacggggtcggcctgggccacggcgacagcgtcgcactgctgctgccgccgcactggcagaccgcggccatcctgctcggcgtgtcggccgccgggctcgccgccgacctggccgacctgggcggcgacccgcagccggtggaggcgctgttcaccacccccgatcgggtcgagcgggcggccacctggtccaccgcggaccggtacgccaccggcctgctgccgctcgccatgccgctgcgcgaggtcccggccggatacgccgacttcgtcaccgaggtgcgcaaccacggcgaccacttccgcggccagccggtggcgccggccgaccgggcgttcgccggcccgatcgaactcagccacgcggacgtgctggccgccgccgaagaccgggccacccagctcggcttcggcgccggcgaccgggtgctgatcgacgtcaccatccaccccgatccggtggactggctgctcgcgccgctggtggccggggcctccgcggtgctctgcgccaacctggacgagagccggctggacgcccgggccaccgcggagaaggtcagtctcgtcctggcggtgtgaccgggtcctggctctccgtcaggcgggccttctggatcgcggtgcggcgggcgaggcggtgatcgcgacggatttccgcctcccggaagcggcgccggtcgtccggatcctcggacagtaccggcggcacggcccgcggcttgccggccacatcgaccgccacgaacaccagataggcggtggcgaccggcagcggggtggcgccgaccacgtcccagcgctcggcggtcaccttcacgccgacctccatcgaactcttgccggtccagttcacctgcgcgtacgcgtgcaccaggtcaccgacccggaccggctccaggaagacgatctcgtcgatcgcggcggtcaccgcggtcccgccgctgtgccgggccgccgccgcgccggccacgtcgtcgacgaacttcatcagcacgccgccgtgcacggtgccgtagagattgacgtccaccgcggtcatgatcctgctgagcgtcacccggctgagttccacggggcgccccggtagctgatcttccacagcaggcaccttacggcgcgccgagcggcggattcccgggcgcggcacaccggtgacgcatgccctaccgcgacacctcccgaccgtccggatttggtcaggcgttgccggtgcgaggtaccgtgccggaccatgcgccacctccggtcgatcgtttacgcactcgtgctcgcccccgccgcctggatcctcgccggcgtcggcttcacccacgacctgaccagccgtggccgggatttcttcaccgccgagtcgctgagcggcctgttgctgctgatcttcgccggagtcctctacggcatcatgatcctgtccccgatctccccggccggccccaccctcgccggcgccgcctacatgggcaccacctggtgggcctggactgccccgaagtcctacgccggaatctggccggccgccgtcgtcaaggacggcttcgacctgagccgcccggcctacggcctcgccgccctgctcgccgtgccactgctgtgcaccgcgctgagcgcccggcgatgggcccgctacgagccgccggtgctgccgatcatcggcgagatcggccggttccgcggctcggccagggtcgccggcgacaacgtcgcggccatcgagacgaccgtgctgcgcaccagcgggccggcgccgtcccgccacccggccccgccggccgccgccacccagatcatcccgcccccggcggccgtttccgcacggcctgccgcaccgcagaccgcggcaccgcagaccgccatccccaagatcgttccttcgccgcggaccgtcgcccctcaggacgacaaaacccgattgctgggtacgccgtcagccaccccgcagctccccacccccgccggcgagcctgcggtccccgcgaccgccggcgacccgacgactccttcagtcggcagcgttcgcgcggcctcggacgacgcgaccgtgacctttgccgcggccaccaccgcgcctaaatctaataaatccggtattaccactaattcggctattaccgccggggccgaaaaatcggacgctcgaccgcccgtcagtgacctctctgacgagaaaaccgtcaccctgactgccgctgccaagcccgccgccacaccggccgccgccgccaagcccgccgctgccgccacaccggccgcggccgcaaacccgtccaccaccccagccgccgcaatggtgaagcccctgccggccgccaccccaaactcggcaaccacgccgggtggcacgactgcgccgagctcgtccgccgcaaagagcgagccggactcggatgacaggacggtgctgttctccgccaagaacgtcgaggacgaagagaccgaagtcctgtcctcgaccggactcgccccggcgaaggactaacccgacaaatcccctccgctcacccaccacttgccatagcagcgaggcgcggggtcgcggtttttggtgttgagtgtcgctcttcatctttgttgtggtgtcggtcgaaagaatccggcgccggagggattccggcgccggattcggctatcgggtcagtggacgaccgggcagccgcccgtcagcttgccgaggaaggcgttcgggtcgtagtagtgctcgacctcgaggagtttcaggtcgtcgttgaccttggcgacgctcatgccgaacatctcgatggtcttgccgttcggctggtggccgttgtactcgccgtcgaaagaaccccagtggcgccatttgaaggtgaccaccggcggggggctgaggacctcgaggacctcccagtagaagccgttcgggaaggcgccgtggaagacgtcgtgctggccgtcgaaggactccggcttgtagaagacgctgtcgccgatcaggatgttgtagctgccctggtccgcgatgtcctgggacgaggcccagccgccgccgttgacgttggtgcggaagtgctcggacaccatcgagacccacgtcttcgggtccttcttgtgcgagacctccatctcgaagacctggacgatcgtctcgacgatggcctcgagggaaccgggggcgtgctccgtggtgcgctgcccgggcatcacgacagccgacaggtggtagtcaggggtgccgtgccggaactccgacgggtcggcggcctcgatgacagcagcgcggccctgcagccacaacggggtctcagtcaagggtgatccttccaacgagggggcgggggccctccaggcgtcgcaccttgattaccccccgtagtccacaaacgatgatcacgatatccacactggatcatccgcaaaaggcctcattggttaacagctattttcctgtcgtcacgagatcatccgagcgcctgttccaggtcggccaccaggtcgtccggatgttcgataccgatggcgattcggacggttccggggcttaggtgtgattcccgcaattgatccggggtcaattggcggtgcgtggtgctggccgggtgcaggatcagcgattgggtgctgcccagcgaggcggccgcccggatcaccgtcaggcggctcatcagccggacgccggcgtcgtggccaccgtccaggtcgaagcagaaggcaccggtgaagccctgcacgaaccggctggcgacggcgtgactggggtgcgacgggtcgccggtccagcggaccgcctcgacggcggggtgggcggcgagccaggtggcgacccgggcggtgttggcggcgtgccggtccatccgcagaccgagggtgtgcaggccacgcagggtcagccaggcggcgaacgggtcggcggtggcgccgaactcgaccgactgctcccagacccgctcgtacagcgcccggtcggcgaagacggccaggccaccggtgacgtccgagtgaccgcccaggaacttggtgaccgagtggaccacgacgtcggcgccgtgctcgatcggacggcagaagatcggcgaggcgaacgtgttgtcgaccacggtcagcaccccggcgtcccgggcgatcggggccagcgtgggcaggtcgctgacgtggccggtggggttcgcgatcgtctccaggtagagcacccgggtccgcggcgtcagcgcggcccgcagttccgccgggtcgtggccgccgatccgggtcacctcgatgccgaagcgcgcggccagatcaccgagctgcgcgtgcgtgccgccgtagacgtcgcgctggacgatcacgtggtcgcccgcactcagcaggccgtgcagcagcagggtgatcgcacccatcccggagctggtggcgatcgcggcggcgccgccctccaggtcggtgatcgcgttctccagggcgcggacggtcgggttcgcgaagcgggagtacgcgtaggcgcgatcgggatggtgcagcccgtcggcgatcagctccgggtcgtcgaaggcgaacgaggaggtctggtagatcggcacggccagcggggtgctgccctgcggaaccggtgccttgaggtggatcaagcgggtttccggatgcatatctcgatgctgcggaccgcggggtggcgcggtcgagggccaatgccgctatattggttcgccaatgagtccaatcgtgccggccgagcttgcggcgcgcctcggccgatggtccgccgggcgcgggccgctctacctgctgctcgccgggcggctgcgggccctcatcgacgacggcgacctgccgcccggcgccgcgctgccgaccgaccgggccctcgcgaccgcgctgtcggccggccggacgacggtcgtggccgcatacgatctgctccgccaggagggccggctggtccgccggcagggcagcggcacctgggtcgccggcgccggagccgagccgccgaacaccaccgaacccaccgtcaacccggtcttcctgcacctgctcgatccgccggaccatgtggcgcagttcgcctgcgccgggccgttggcggcgccgccggaggtcatcgcggcctaccgcggggcgctggaggcactcggtgggccggatctcggctatcacccggccgggcatccgcggcttcgggcggcgctggccgagcggtacacggcgcgcggggtgcccacctcaccgggccggatcctgatcaccaccggcggtcagcaggggttggcactgctggccagggcgctggtggcaccgggggcggaggtgctggtgcaggcgccgacctatccgggggcgctggagatcttccgagagtcggcggcggcgctggtgccgatcagaaacacgatcgaggggtacgccgcggcactggcccgcaagcccgccctggcctatctgatccccgccaaccacaacccgaccggccacaccctgcccgaaagtaatcgccgcgcgatcgtcgcggcggccctggcgcacggcgtcccgctgatcgtcgacgacgtgacggcagacctgacgttcccggaccggcgagcgcggaccgcgccggacgccagggctgcgccggacgccgcggccgcgccggacgccgatgagttgatcacggtggggtcgctcagcaaagtcgtgtggggcggcctgcggatcggctgggtgcgggcacagccggccctgatcggacgcctcgcccggctcaaggcggtcatcgacctgggcagcggcgtgctggaccagctggcggccgtggaactcctggagaatctggacgacctggccggacagcggatccggacactcgccgcccggcacgatcacctctgcgctgagctgcggagacacctgccggagtggcagttcgagccggcccggggcgggcagacgatctgggtgcggctgccccacggggacgcggcctcgtatgcgcaggcggccctccgggaaggcgtcgcggtcctgcccggcggatcgctcgatccgtccggtgcgagcacggatcacctgcggattccgttcgtcgccgagccggcggcgctgaccgccggcgtccgggcgatggccgccgcgtggcgcggcttcaccggccgcgcggcgatcagcccgccaccgctacccgccatcgcggtctgaccgcaggcagggcccgacgacccggcccggtttctgaggcggccggaggcgagcttgtggcgcgcctccggcagcccggcgactggctgcccctacacggccagccgtaggtagtccaggttgaacccaccgctttcacagtaaaccgtaagcgtctgatcaccatcagccagcgagaccggcacgtccaccgtttggtatgccgcccagccgccggtgtccggcaccgagacgccggccagcacggcgccggacgcgtcccggatcgagatcgcgccggtggccaccgccccggtgccgttggcgacccgcagctccagccggtgcgggccggccggcacgtcgaagcggtaggcgagccagttcccgggcgcggtccagccgacgtccttgccgccgctggccgcgccgttgctctcgacgaagtcggcgccgccctcggtccagccgtgctgtgcggtgtacgcctcggcctcgacgatcgcgccgaccggggcgccgtgcgggacgacggtgacgtgcacggtggtctcggcgtacgccttgccgtcggtgaccgcgacggtgacctgctgctcgccgggcactgccgggtccagcgtcaggaccccggtgtccggatcgacgctcgcaccggccggcagatcgaccgcgtagtagtgcagcctgtcatgatcaggatcggtcgcatgcagggcgatccgggtggtggcgtactggtcggcggtcaccgggggcacgccgggcagcagcggggcgcggttgtgccgcgagtccgtccggctgccggtccatcgataggtggcgtacgccccggcgggcaccgtggtgacgaaggagtcgtcgccggccaccacccgcacggcggtgtccgtggcgttggcgttgcccagcaccgcgacgtagtcccgcccgtcccggtagacgacgttgctgatcccgtggcccgtggtgctggactcgacgcgcacatgcgcgggcgtcaggtacctggcgaactggcccagttggtagagctcatcgcgtaccgaataatccttggtgatggtgttgaccttgaccagccgatcgggccacctactggtccgggcgacctcgtcccagtcgacgttgttgttgcgctcgccggtccagtgcagggtgccgccgtcctggtcggtggtctgcgcccagaggatgtaactgctggcgtcgagccggaagtaggacagcacggtcgacggggacaggtcgctggtctcggtcatctgcaccggtttgccggtctgccggtacgcgtcgcgcatcacctgcgggtcaccccagtacgggtggaacgcgatcgcgtcggcagcccgcgcggcctgcgggtcgttcaggatccggtagtagttcttggtggccgtgctgttcgggtcgcgccagtcccagaagttgaagtcgtggacgtagaggctggtgcgcagcccggcccggcggaactcgcgcttgatcgcgacggcgagtctctgctgctgctcgacgctgatgtccatggcggggtagacgacgtccatgcccggctcgttgagcagcgtgatcgcgtcgaccctgatgcccagccgggcgtactcctgcagatacctgacgtagtaccgggcgaacacgtcgatccggtcgtcgcgcagcttgccggcctggtagtagtcggtggtgctgcccggcttgagggcgacctcgccgaggaacctgttgttggtcttcatccaggccggggcgctccacgcggaggcgaagaaggtggcccgcgggttgtacttctggatcagcttgatcgtgtcgacgatgtgcagatccaggtcgcgctggacggagaagtacttcagctccgggtcctcggtgaccccggcgggcaggtcgtcgtaggaccagaacggcaggtgctcgatcaggtcggggctgccgatggtgaggcggaagcggtccaggccggcgccggtgcgcgggtcgaccagcagcttgatcgcctgttcccgccggtcgggagtgagcttccacaggttggcgacggcggtctcgtcgatcgagaagccgacgccctcgtatcgctgttcggtccggctcgggtcgatcaccaccgtagcggcagattgtcccgtttgcgcgacgtgagcgggctgccaatgggccgcaccgaccgaataggtgccggtgaccgccggccgcgggcagggcacagcgggcgtggcagcgaccaccaccgccatcgccatcttgagcaacatcagttgagcacccacttctggttggcgccggaggtgcaggtccacacctgcagccgggtcgcgtccgcggagctgttgtccttcacatcgagacatttgccggaatacgagttgatgaggtgctgaccggcaccgtcgtaggtccacttctgcgacgcaccggtgtggcagtcccagagatgcgcgagcgtgccgtccgccgtgctcggccccacgatgtccaggcacttgccgagtgcccgcagcgtcccgtccgacgcccgggtccaccgctgcgcggccgaggagttgcaggtgtagagctgcacggccgtgccgttggcggtcgccgccccggccacgtccacgcacttgccggccagcccggtgatcgtcccggacggatccggtgcggcggtgcccgaccaggtgaaggtcgccgtcgtccgggccgggagggtgtagatgaacgactgcccgccccagttgacccgcaccgactggctggacgtgccgccgttgtgcgcgatcagcgccttggagccgtccgggttgcgccaggccacgttgcggaccgcggagccgtcgttgctgtcgatccggaccgcccccggcttcacgaacctggtgaggtgacccatcgtgtagtactcgacggtgtagtcgacctgaccggcccgggagccgccgttctgcacggtgatgaagccggtgcaggtgccgcagccgccgttgtgcgggcccatgttctgatccacgccgaggctccacttcaccaccgaagcgccccagttccgggtgtagtcgatgatgttgttcaggtcctcgttgtgctggtcaccgatccaggtgccgccggagtgctcggtctcgaactgcttcacggccgggtacgtggcgtgcacgtcgctgccggtggaggcgctgcccgagtagccgtgccaggcgatcccgccgaatgccgggtcggtgcggatccccgcgtcgcccaggatccccgagccgaaactcgcgtagtcgccgtagttccagtcgtgcaccagcaccctggtgttcagcccggccgcgtgcagcgccgggtacacgttgttcttggtgaactcaaccagcccggacgggttccagctcatccccgggtaggtcatcgcggtcgggttggatgcctggcagcagttcggctcgttctgcaccgacaggtagtcgaccggcacgcccgccgcctggtagctctgcaggtacttgaccagatactgcgcgtacatcgggtagtacccggccttgagccagcccatctggtccatccggccgttgtccttcatccagcccggtgcgctccacggcaccgccatcacccgcaggctcgggttgagctgcttcgcctgctgggtgagcagccgcacgttcgtgtcgtagccgttggcgccgaaatcagcgaggtcgcaacacgtgtcgtccagcgacacgttgcccggcctcgaaagatcagaagcaccgatcgggttgcgtacgaaggacagcccgatcccgcccgtgggactgaacagtttcgtcatcacggcgtcccgggtggccgcgctgaccgccccgccccgcagcaggtaggcggtggtgtcggtgatcgacgcgccaccgccctcgaaggtctggtaggtggtgccctcgtcgacgttgatcgtggtgccggcgctgccaccggccgggccgaacgcgatgttcgtctgctgctgcagcccgcgggtgaccgtgcgcccggcactgtccgacgtggtggtgagatagacgctgacggtctcgccggcggcctgcgcggcgggggcgtagagcaggctgccgcccagtatcgccgcggcgaacagggtcttccgcatgactgactccctcgggggaaggggatggcgtaacaggaaggaaacctttgccaaataagccagtcaatgagttgacggttccggatgcggtgttcgcgttccggaaccgtgaaacacgtcaggccgggaccggcccggtcgagccacgcaccaccagctcggtgcccagctccaggtgcaacgcgtccagccggtgcccgcccagcatgcgcagcagcaggtggaccgccatccggcccatctcgccgagcggctggcgcacggtggtcagcatcgggtcgcaggccgagccgaggtcgatgtcgtcgaagccggccaccgacaggtcgtgcggcaccttgaggccccgctcggcggccgcccgcagcgccccgatcgccatcttgtcgttgaacgccagcagcgcggtcggccgctccggcaggtccagcagctccaccgcggcccggtagcccagcccggtgttcggctcggcgacgaaccgggtcagcgccggatcggccagcacgccggcgtcggccagcggcgcgagatagccgtggaagcggttgtcgctggccagccagtcacgcggcccaccgatgatgccgatccggcgatgccccaggccgatcaggtgggcggtcagcgcccgggccccggcgaagtgcgcggcggacaccgcggccacgtcccgcgggggcgagatccgcggatcgaccagtacgaacgggaaaccgcggtcgcgcagccggaccagctcggcgcccggctccggcggcaggatcagcacggcgccggccacgtcccggcgctccggcagggtgggcagcacccgggtctgctgggcggaggtgccggcgttcaggatcacatgcaggccgtgcggctcgcacgcctcggcgaccgcggagacgatcagcccgaagtagtcggtcagcacgtacggacagcggacgaagacgccggcggcccgggcccggacgccccgccgacgcggggcgcgctcgcccagcgtgcccatcgcgcgcagcacccggtcgcgggtgtccggagcgacgttcgcccggtcgttgaggacccgggagacggtggcgatggacagaccggtgcgggccgccagatcacgtaccgtgactcttgtttcatcgccgtgtttcatcggcgaatcatagatgctcctcgctgccgtgcataccgggcagtgaccgggtagccccccggtactacgcgtgacctcccgccacggattgacgttctccgccaagtcgtcctcctaccttcgtcgcacatcggaggacggccctgagggggaaacgatgactcgctggtggatcgtggcagtggcgctgctcctggtgccggcactcgggctcttcgggccgacgtcggcgaccgccgagcagcctgaccggatcgccgactggcgggcggacgcccggcatctcccggacccggcgagcaccgcgccggaccggatcgccgccttcttcgccggtctcccggccgccgcggcggacgacctggcccgcgagtaccccacagtggtcggcaacctggacggcgcgccgccgggcctgcgctacgcggcgaaccggacgcccggatacgccgggcggcagatcctcgccctggaccggcgcggcgacgggcggatcgccgaggtcttcggcgacctggacaccgtcgaccgggtggtgatcctgatccccggggtcgacaacacgctcgccgacttcgacaccgggctcggcggcgtgcgccggcgctccccctcttggcaggcgcaccagctgtaccagcggatcggtaccggggaacgggtcgcggtgatcgcttggctgggctacgacccgccggagggcatccgccgggcggcgctgcgcgaggaccgggcggccagcggggccctcgccctcgaacggttcgtcggcgggctggtggcgcggcaccccggtcagcggatcacggtggtcgggcacagctacgggtcgatcgtcgccgggtgggccgtggcccacctgccggcccaggtcggcgacgtcgtggtgatcggcagcccgggaatgggcgtcagcggccgcgaccagctgggcgggaccgcccggatctgggcgggcagcgcgcccgacgactggacccgcaagctgcccggcatccggatcttcggactggggcacgggcgactgccgatcgaccccggcttcggggcgctgccgctgccggccgggaacgtgtgcggccacgacggctacttcgtggcgggcagcgcggcgctggacgcgatggccgagatcagcgtcggcgacatccggctgacgccgctgccggtcgcctgatcggcaagccccgacccgccgctctgctgatcagccggcacgcagcccgccgctctgctgatcagccggcacccggcctgccggtctgctgatcagccggccaccagtcgcagcggggccagcgcccgcagcgcctcagcggtggcctcgtcggccgggagctggatcagcagccgcagaccctcgtcgccgggcaactccaggatctcgtaggcgagccgcagcgggccggccgccggatgctccaggcgcagcaccccgtgcgggcgcggcaccccgggcacccgctcggcccgctcggcgaactccgcgccggccagcagcagcatctcgtcggtgaagtccggccggggcggcccgttcttgagcgcggccacccgctcgtcggccacctgagcccagtccgggtacgcggtgcgtgcccgggggtcggtgaagacgtaccgggtcagattgggttcggcgccgtcgagcagcccgatcggggcggccagccgggcgaacccggcggtgtgcgccagcacgtcacccacctggttgagcagcgccgcggcggcgggctccagctggtcgagcaccgcgcgcaggccgggccggacggtccgggacggcgcccgctcccccgccccgcaggtgaatccgctcgccgacttggtcagccggtagaggcgggcgcgctcggcggcggtcagccgcagcggcccggcgagcgcggccagcacctgcggcgacggccggcggtcccgcccctgttccaggcggatcagatattccacgctgaccccggcgagcatcgccacctcggcccggcgcagcccgggcgtccggcgccgggaaccgggcggcaggcccacctcggccggggtgacctcggcccgccgggcgcgcaggaaggcgcccagctcgttgtcgctcaccgcccgacggtaacccggtcccggccgccgagggtgtccctgccactaccaccctgagcgcggcctccctgccggccgccggacggcacaggctcaggccatgaaacctgaagtgatcgtggtgggtggcggttacgccggcatcgtcgcggcggccgcgctggacgacgtggccgacgtgacgctggtcgagcccaccgagacgttcgtgcaccacgtggccgcgctgcgcgccgcggtcgacccggactggaccgaccggatcttcatccggtacgacggactgctcccccgtggcagggtgatccggtcccgcgccatccgggtcacgccggagacggtggagctggcctccggggagcggctgcacgccgactacctggtgctggccaccgggtcgagcagcccgttcccgtcccggatggacagcccggacaccgccgtcgcgcgggaacggctgggggcggtccgggacgccctgtcccgggcgtcgcacgtgctgctggtcggggccgggccgatcgggctggagttcgccggcgagatcgcggccgcctggccgacgacccggatcaccgtgctggaccgggcgccggacctggtcggcggccggttcccggacgcgttccgggccgagctgcgccggcagctggacgcgctcggcgtccggctgctgctcgggacggccctgaccgcgccaccggcagtggagccgggcacggtccgcccgttcaccgtcaccacggcggccggggagatcatcgcggccgacctgtggttcccctgccacgggaccggggtccggtcggagtacgccgacgggtcgctggccggggcgcggcgggccgacgggcggctcgcggtcaccgagcacctgcgggtggccggacacgaccgggtcttcgcggtcggggacctggccgggaccgacgagctgaagatggcccgggccgcggcccggcacggtgaggtggtggccgccaacatccgggcgctgatcggcggcgggccgctgaccgcgtacgagccggcgccggacgggatcgtgctgccgctcgggccgcacggcggggtcacctacgatgcggacgccggcctgctcggcccggagacgaccgccaggatcaaggccaccttccacatcgagagattcctcgatgtgctgggcgcgcaggtctagtgacggcgctggcgggcggcttcgtagaggaccacggagccggccgccgcggcgttcagcgagctggccgcgccggtcatcgggatgcgcaggatgtggtcgcaggcctcccgccaggcgccgctgagcccgcgggtctcgttgccgatcgcgatcaccttgggcccggtcaggtcgtgctcgtccaggtccacgtccccgccctcgtcgctgccgaggatctccaccgggagaccgccacggcgcaggccgatcacgtggtcgaccacctcacggtgactggcgacctgcaccaccggcagggcgaacagcgagccggtgctggcccggaccgccttcgggtcgtacgggtcggcggcgtgaccggcgatgatcagcccggtggcgccgaacgcgtcggccgaacggaccagggcgccgatgttggccggcgtggtgggccggtcgaagaccagggcgagcatgtccggcccggccccgatccgggtgaggtcgtcggccggcatgccgaccacggcgagcagctcgggcgactcctcgtccttgccgcccagctcgtgcatcagctcgccggagacggcgaaccgggccgcgtcggtgcggtccaggacgtcccggctccaccgggacaggcgacgggcgtcgtcgagcaggaccgcgtgcaccggccagccgtggtcgacggcgagcgtgatcgggcggacgccctgcaccacgaactcgccggcccggtgccgtttggtgcggttggtgagcagcgcctgccactgctggaaggtcgcgttccgcgtggagacccgcattgtcctggacattcccactatccaagcagtccggtcgtggcctctgcgcgtcgggtatggtcccgatcgtgacgcatttcgtggcgctgcttctcagccgccacggcggggcctgatccgacgaccggctccccgccgtgggggctgttcgtgctttgccggtcgatgtccgtttcccggcaaacccgttctggagccccgtcatgatcacctggaatccgcagcagcccagcccgatgccgttccaccgttaccgccccgcccacgagcgggtcgacgtgccgatcaccgaccgcacctggcccacccggcggccgaccgccgccccctgtgggtcccggtcgacctgcgcgacggcaaccaggcgctggccgaaccgatggacgccgaccgcaaactgcgcgccttcaccatgatggtcgcgatgggtttcaaggagatcgaggtcggctacccgtcggcgagcgggttggacttcgacttcgtccggttactggccgagcgtgacgacctggtcccggacgacgtcaccgtggtcgtcttcaccgccgcccgggacgacctgatcaggcggaccgtggcatcgatcgacggcctggccagggcggtcgtgcacatgtacacggcgaccgcaccgacctggcgcgacgtggtgctgcgggcgtcccgggccgggctcaggacaaggatcctgcacgcggccggggtggtgctgtccgaaactgatcgactggctcacacgtacacccgcttcgagttcagtcctgaggtcttcaacctgaccgaaccggagttcgtgctggacgtctgcaacgcggtcaccgggcggtgggacgccgccccggaccggccggtgatccacaacctgccggccacggtcgaatgcgccaccccgaacgtgtacgccgaccagatcgaatggatgagccggcacctggaccggcgcaacgacgtgatcctgtcggtgcacccgcacaacgaccgcggcaccggggtggcctgcgccgaactggccgtgctggccggcgcgcaacgggtcgagggctgcctgttcggcaacggtgaacgcaccggcaacgtcgacctggtcacgctggcgatgaacctgtacacccagggcatcgacccgaagctggacttctcggacatcgatgcggtgcgccggaccgtcgagcactacaaccggatgcccgtgccggatcgccacccgtacgccggcgacctggtctacaccgcgttctccggcacccaccaggacgccatcgacaaaggcatgatcttccacgccaaacgcgccgccgcgctgggcgtgcccgagtccgaggcgccgtgggaggtgccgtacctgccggtcgacccggccgacgtgggccgctcctacgaggcggtgatccgggtgaacagccagtccggcaagggtggggtggcctacctgctgcgcaccgggcacggcctggacctgccgcccggcctgcgggtcgaggtcggcgcgctggcccaggccgcgagcgagggacgggccggcggcggcgagctgaccccggccgaactgtggtcgctgttccgcgacgaatacctggtccaccccggattcccggtcgacctggacggcgtcgaggtgatcgaggaggtcaccggaaacttccgggaggcgatcatttcgtacgttcgttgccggatcgccgaggtggaacgctggggtgccggcgtcgggtcgaccccggaagccgcccggcacgccgcgatgagcagcgccgcccgtcgcgccgtctgacctgcttcccggccggtccgcacggtggtcccgggatcaccgtgcggggcgggggctcatgtcgtacgaccgcaatggcggcagcgggcagcggaaacccggcgccgggccgcggtccgggggtcttctagcatgcaacgggcgggtgacgagggggtcgggatgagcgccgagcaggcgcggtggccggagttgtcgctggacgtcgccgcgctgcggcgcgccgggcatcgggcggtgccgttccgcgacgtggtgctgaaggtgcatcagcggtgcaatctggcctgcgactactgctacgtctacacgatggccgaccagtcctggcaggatcggccgcgggtgatggaccgggcgacgtggcgactcgccgcgcggcggatggccgagcacgccgacacgcacgacctgccggagatgcggctggtgctgcacggcggcgaaccgatgctggccgggaccgcgctgctggatgagctgatcggggatttccgggcggtgttcccggccgggcggcgtctggaggtgctgatccagacgaacgggacgctgctcgacgaggccgcggtcgcgatgttccgccggcatcgggtccgggtcggggtgagcctggacggcgccgcggagagcaacgacctgcgccggcggcgacccgacgggctgggcagctcggccgccgtcgaccgtgggttgcggctgctcaccggggacgtcttcggcggcctgctgtgcacgatcgatccggccaccgatccggtcgccggctacgaggcgctgctgcggtatcgaccccccgccatcgacctgctgctgccgcacgcgaactgggagacgccgccgccggcctcgtgcgccggctggctgatcgcggtcttcgaccggtggtacgacgcaccccgccaggagacctcgatccggctgttcgaggacgtgatggcgctgctgctgggtggttccggccggtccgagcagatcgggctgagcccggtggcggtggtggtgatcgagagcgacggggcgatcgagctgaccgactccctcaaatcggcgtatccgggggcgtgcgcgaccggccggaccatcgccgccgacccgctggacgcggtcctcgaccatcccggcgtggtggcccggcagatcggcgccgacgccctgtccgacgcctgccgggcctgtgacctgcaccgggtgtgcggtgccgggcactacgcgcaccgttaccgcgcgcccggcggtttccgcaatccgtcggtgtactgcgccgacctggccgccctgatccggcacgtgcgccggcggctgaccgccgatctggctcagcgggtgtaggcgatcaggtccaggtcgcgcagcgaggccggttcggtggcctggaccagcagcgtcccggtggccgagaacagcgagagcaccctgcggtccccgtcggtggcccggaccatcaggttgccgtcggtgtcgaagagcgccgactcgaccgtgccgggcaccgggatcgggtcgagggcgccggtgctcgcgtcggccaccgtgtcggggcgctgatccacgtcgaacgagttgctcagccgcagggcgaaccgcgcgccggtccggtccacgctcagcaccaggtcaccggagagctgctcggggttgcggccgacatcggggtccccgaagaccgggacggtggcggcgcccacccggatccgctggccggccgtgtagaacagcttgctgccgtccccggaccagtggaaattctgtcccttcagaccacccgggatcgggccgagcttgccggtggcgacggtgagcacggccggcgacggcgccgcgaccagcagccgggtgccgtccggcgaccaggacggcagctgtttggcgatgtcgaccgtgccgctgagcagcggctgggcggcaccggccagccggagcttgccggccgacacgtacgcgacctgccggccgtccggggagatcgcgaccgcctggttcgccctgtccagcaccgtggtccgggtgccgtcgccggtgaaccggaccaccgtgccggacttggaccggtagaacagctcgccggtcagcgcggtcagcgacttcgacgcgggcaccgccatggtgaccgtggccgggccgctcggcgccggcttgcggaccgtcgcgccgggcgacgggctgacgctcgccgcgaccacggccggcgggcccggtcgggtccggaacgcgtcgaggttcgccaccccgaagccggccaggcccagcaccgccagcgcggacgcggtgaccgcggtgatccggttgcggcggatctgccgggaccgccccagcgcccgggcgtgcaggtcgacgaagtgcacgtcgtcggcgatgccggagagcgactgccgcaggtcctcgttcacgcctgcgcctccaatgcccgcatgtccggcagcagggtgcgcagcttcgccagcccccgggcgcattgggtcttgaccgtgttgaccgacaccccgagcagctcggcggcctcgctctcggagtggtcctcgaagaaccgcagcacgatcaccgcccgctgcttggcgctgagctggagcaaggcgttgcgcagcaccagccgccgagtggtcgcgtcggactcgtcggagccgtcgccgccggcgcggtccggtagttccccgggcatgacctcggcgacccggccgcgccgccagaaggagacctgggtgtggtacatgatctttcgagcgtacgcctcggcgttcccggcccgatccaggcggttccacgaccggtgggtacgggccagggcctcctggaccaggtcctcggcgaggtgctggtcaccggtgagcaggaacgcggcgcgcagcagtgagtgcgtgcgggaccggacgaactcggcgaagtccgcgtcggcttgatccatccccgtacatccgatctcgtggtgctgagatcggtgatcttaaaggtcgcgatggccatcacgctgtcccccactgtggatcactcggcgtagccgctgaggcgggcgtcgaagtcgagcttcatcgagaaggacctgctggtgagcacccggccggccgcggagaacagcgtgagcgtctgcgtacccgccacgtcaccggtgccggccagcaccgagccgtcgcgcaggatcagcagggagcccggaccgtccttcaccacggtcggcacgaccttgccggtcgccgtgtcgatcaaccggtccggggttccccccgcctcgtcgttcccgtcggtcatccggaacaggatggcggtgatccggctgccgtcggcattcaccgtgccgaggacgttcgcctgcagccggctcgggttctgcgcgctgctctcggcgccgatgaccggcaccttgcgcaggtcggacccgtccaccgcggtggagcagatcacacccttgtcgatgaagaagatccgcttgccatcgccggacatcaggtagttctcgaaaccctgcagggacttgggcagcgcctggaacgagccgtcggcgatccggaagatgccctccgtgaccttggtgatccggtttttcgtctgggcgtcgatgcgccgcacgaggaggccggcgctgtccgcggtccacgcggggccgagattggtcgaaccgtcactgatgtcgatgtcgaacttgtaggtccgccggttcttgccgtcgacgccggagacggtgagttcgtcctcgacgtaggcgaggtgcctgccgtccggcgagacgctcggcagggtcagcatccgcccgggcgaccggtgcaggacactcggtttgccgtcccgcaccccgtagaccttgtcgagattcgcgtagagaagggtgccgtcgatggtggccgccctcgtactctcggccggcggactgctcgggaccgcagccggtgtactgctcggcgcgacgaccggaggcgccacggtgccggccgtcccctccttcccgccgccggtgcagccggagatcaacagggcggcgacggtggcggtggcgacgagtccggtcttgatggcacgcatttcctgctcccccgtgggcggttcattgctgacgccggtatagacgccgatccgacccaccctcaggtgacaccttcgccgagaaattcccacttttttgccgggcacgcgacgggggccgggcgggtgcccggcccccgtggtgcgggcgaggtcagccggcgtcctcggcgagggccgagaccagcgccgccaggtcgtcgtcgtccagcgacagcaggtcgtccggggcgggctcggccggggccggggtggccggcaccgcccgttcggcgatcttctccaccgtgtgcagggtcaacacgtcgccgaccccgatcagccagccggcgttgcggacccgggtgaccacctggatcgcccggatgctgtcgccgcccaggtcgaagaaggagtccgaggcaccgacccgggaaaccgagagggcctcggcgaacgcgaccgccagggcgctctccaccgcgccggaggcctcgcggccggcggtcacggtcacctccgggtcgggcagggcggcgcggtcgaccttgccgttggcgttgagcgggagcgccggcagcaccgtcaccacggccgggaccatgaagtcgggcatgctctcgcgcagcgactcccggatccgggtcggttccggggtctcgccggcggcgccgaccacgtaggcgaccaggcggcgggcgcccggggcggtctcctgggcggtggcgtacgcctgggcgatctccggcaggcgcagcagcgccgcctcgacctcgcccagctcgatccggaagccgcggatcttcacctgctggtcgccgcggccgacgtattcgagcacgccgtcctcgcgccagcggaccacgtcgccggtccggtacatccgggagccgggcgggccgaacggggcggccacgaagcgttccgcggtcagcgccggtcggttcaggtagccgcgggcgttctgccagccggcgacgtacagctcgccggacaccccgatcggcaccgggcgcaggtccgggccgagcacatagacccgggtggcgtccagcgggacaccgatcggcggggtgccgccggactcctcgacctccatggtggtggcgaacgtggtggtctcggtcgggccgtagccgttcatcacccggatccccgggcaggccgcgcgaaccagccggatcgcctcgccggaggccgcctcgccgccgcacgacacggtgcgcaggccggcgaacgcggccgggcgggtgccggcgatcaggttgaacagcgacgtggtgaggaaggccgcggtcaccccgtgcgccgcgatcaccgcggccagctcgtcggcggtcacctggccgggcggggcgaccacgatccggccgccggtcagcagtggcgcccagatctcgtaggtggaggcgtcgaaggcgtgcgaggagtgcatcagcacccgctcgtggtcgccgtccgaccaccggtggtgcgcggcgaaggcgagcacgttgccgtgggtgaccgcgacgcccttgggccgaccggtggagccggaggtgtacatgacataggccagccggtccgggtcgccgccgcggtgcggggcggtggccggcgccgcggcgctcagatcggccgcggacagcagcagcgcctcgaccgggtggtcggccggcacgtcggtgagcagcagccgcaccccggcgtcggcgagcatggcgcgctgccgggcggccgggtcggtgggccgcagcggcagataggccccaccggccttgatgatcgcgagggtggcgagcaccaccagcgccgaccgctcggccaggatggcgaccggctcctcggcccgcaggccctggtcgaggagttcggcggcgagggcgtccgcggcggcgtccagctcggcgtacgtgatctcccgcgccccctcggtcaccgcgaccgccccgggtgtgcgggcggcccgcgccgcgaaggcgtcggccaggtcgccccggggcgccggggccggggtgccgttccagtcgtgcaggagcagctcgcgctcggtcgccgaggtcagctcgaactcgccgagcggcgtgtccggcagggtgctgacctcctcgaggaagcgcaggtacaggttctcgatcacggcgaggtcggcgcgcgcccagcggtccgggttgccgtccacgtcgagccgccagccgctgccgtcaccccggtcgtagaagcccaacgacaggtcgtcgaccggcccgagggtgaggttgcgggtgaccgtgggcagcccggcgagggtcacctggtagtcgaaggccatcacgttgaccacggtgccccagccggtgccggccgcgccggcgtgcgccggctgccaatcctcgaaccggcaacgctggtgccgcagcgcgagacgcagcgctccggagacccgcggcaccaggtcgcgcagcgtgtcaccgggccgcacctcgatccgcagcgggaccacgttggacgaatggttcggggtggcccgcagctgcctggtggtccggccggtgaccgggacgccgagcaccacgtcggtacggccggtgcagcggtgcaggaacgcggcggtggccgccatcagcagcaccggccagcgggtccgcagctcgcgggccacctcggcgatcgcggcggtgcgcccggccgggacgctcgtcgagcggcggatgtgcacggcgcccgggtcgggggtgtccgggccgcgggtcgcccagtggtcgctcagcttcaccgggctggccgaggacgcatgctcgcgccagaaacgcaggtcggcctggaactcctcgccggcccggtactccgcgtcggcggtcagggtggcggccaacgactcggcgggcggcggcgcgtcggcgagcggcgccccggtgacgatctcggtgtagtacgcgccgatcttgcggaacagcagcgccgcggcgtacccgtcgcaggcgatgtggtggccgcggccgtagtagacgaaccgtgcgtcgccgacccgcagcagggcgaaggtgaacagcccaccgacctccaggtcgatccggcggtccaggtcggcacggatccagcgctgggcggccgcgtccgggtcgggctcggtgcgcaggtcgacccgggtgatccgggcgggcgcctcgtcgatgatctggtagagctcgccgctgtcgtcgcggcggatcgcggtcgccttgaaggtcggcgcctcctccagcacccgcgcccaggcctgctcgaaggcgtcctggtcgagatcgccgtccacctcggtgtactccgcgatgttgtaggcgtgcccggtcggatcgagttcgtgcccgagccagatgcccatctgtccggccgacaacggtaaccgcatgaaagtctcacctcacgacagtggagccctggatacgggggaatcgcagggctccactgtgtcggtgaggtctatatttccgttgtcagccgacctcgcgcatcatcttctccatcgccgcggtggcctcgcggacgtgcgtgagctcggcgaccgtgcgtttctgcaactccgcgttctccgccagcagctgggcgcaccgctcggcgagctcccggtactgcgcctcgcgggcggtggccagacgcgcccgccaggtggcggcgagctgccacacgatcacgatgagcacgacgaagatccccgcggcggccagcaggctcaccacatcgtcgccattggaacccaacgcactcaccatcactttcacttctcggtggccgcgtcggtcagcgtcttgaccgcctcggccaccgtctgcggtgtcagttgcaacgcgaacggcgtgacctcgaagaacttcatcgccttaccgtccgcggacagctcgagactgccctcgatcaggccggcggcctccagccgggcgaggtgcatgtgcagcaacggcctgctcatgcccagccggacggccaaccggctgacgtagtcgcgctcggcggagagcacccccacgatccggagacggtgcggattgctcagcgccgtcaacatcttcagcaggtcatcacctgtgacatccatccgcgttgacctctttccggcgcacgagaagcttcgcacacccacccgaggggcgtcaacacttcatgacaggtgtcagaaaaatctgatcagtagccgccccattgcgccacgatcgtctcccgctccgccgcggtgatcaggtcgatctcccgaactcccacgtccaggtcaccggccaggctctccagggccagcatcatccggtccaggtgcgcctccgcgtcggccggggccaccaggtcgggccggaagccgagccgcacggtgagccggtcgtccggccccgggaccgcgaccagccgcagcggatagtgcgtggcgtcgtccaggcccaggccggtcacccggtacccggcgccgtccggctcggccagcacctccacgtcgaagggatagttgaccagcatcgtggtggtgtcgaacagctgggtgcagccggtcagccggtggatccggccgagcccgaggtgctggtggtcgagcagatcggtctgctcgccctgcagcacggtaagcgcctcgccgagcgtcgtcccggcgtgcagccgcacccgcaccggcacggtgttcacgaacagcccgaccatccggtcggcgcccggcaggtcggccggccgcccggagacggtggtgccgaacaccacgtcgtcccggccggtgatccgggccagcaccagcgcccaggcgaactcgaccgcggtgttgagggtgaccccgagcggccgggccgcgtccagcagccggcgcaccgtggcaccgggcagctcccggctgatctgccgctgggcggtcaccgccgcgcccggcgtctccggcgccaccagcagcgggccgtcgaggtcgcgcaggttctccgcccaggctcggacggcggccgccgggtcccggccgaccagccacgcgacgtggtcgcggtgcgacggcgcggtgtcgtccgtgagcgcggcccggtccgaccacatcgcccgcagctcctgcaccaggatcggcagcgaccagccgtcgacggcgatgtggtgcgcggtgaccgcgagccgccactcccggtcggccagccgcatcagcgccagtcgcagcagcggtggacggtccaggtcgaagtcgtcgcgctcggcctcggtgagccgctcggcagccgcctcccgctcgctcgcgggcagcacggtgaagtcgacgtcccgccacagcgcgaccccgccggaccgcaccacctgcaccgcggccccgctctccagctggtggaagccggtccgcagggccgagtgccggtcgatcagccgctgcccggccgcccggatccgggtcggatcgacccggccggacagatcgaggcgcacctgggtggtgtagacgtcggtgccgccgtcacgtgcctccgccgcgtggaacaggaagccctcctgtagcgggctggccggcagcacgtcggacaggtccggcaccagcgactccagcgcggtgacctcggcctggccgagcgccgccagcggcaggtcggccggggtgcggccgccgggcaccgccgggtcggccagctcggccagcgccaccagggcgtcgcgccagcgctcggccggcgcctcgaacccgtccgcggtgatccacagcgcccgcagggtcccgtccgggcggcccgcgacgtgcacctccaggtggtagccgagcggcatgcccgggtcgaccccggagggcagcggctcaccggccagcagcggccaggccccggccaccgcgccggccgtaccgcccaggtagttgaacaggaacggcgccgggtccaggtcgtccgcggccggggcccgcagttgctccttgacccgcagcacggcggctcgcgggtcggcgccgatcccggtcacccggaccgggcggaccgcggtcagccagccgacggtgcgggacaggtcggcgtccgagtcccggccgtgcccctcgatgtcgatcaccgcctcctgggtcagcgcccgggagtatgcggtgatcagcaggtcgtccaggcggccgtggaacttctcggccaccgtgccgaggcgggtgaccacctcggccggcacggtgacctcggtgtgccgggcgtcccgggcgaagccgtaggtgcgccggggctgccgggcgacctccggcaggccgcgtgcccaggtgcggtaggagaccggcaccggctccaggaccggcgcgacgccccggccacgggcctcggcggccgtcgccaggtcgggcagcagcacctgccaggagaccgcgtcgacgaccaggtggtgcgcgacgagcacgagcctgcggtgatccacccggaccgccaggacgttgatccccgccgtggggtccagacgccgggcggcgaactcggccgcctcgaaagcggctccctcgaaagtcagaagctccacggccgcagcggcggggatctcgaggtcgccgtccgcggtcagccgggccgccagtaccgggtggtgaccgaccacgtcgcgcagcgcggcggccagtgtcgcgtcgtccagcccggccggtgtctcgaccaccaccgcctgatggaagccgtggaacccaccgccccgggcgaccagcgccctagctagctagacgggcgaccgccgccagcgccgccgcggtacgcagccggaacacgtccttggcggtggcgacccagccggcctgccgggccagcgacaccacccgcatcgccaggatgctgtcaccgcccagatcgaagaagctgtcggtgaccccgacccggtcgtgcccgagcaccacggcgaaggcatcggcgaacgcggtctcggccgccgtgcgcggctcgccgcccgccgcgccggcggtcaccggcacctcaggtgcgggcagcgcggcccggtcgaccttgccgttcggggtgaccgggaacgcgtcgagcagcagcaccgcggacgggaccatgtgcgccggcagcgtgccggacaccgcggtcagcaggtcgtccgcgaccagggtgcggcccggatcggcgatcacgtaggccaccaggcgctgcaccccgggccggtcctcgcggaccagcaccagcgactgtgacacccccgggcaggcggcgaacgcggcctcgatctcgcccggctcgatccgctgaccgtgcagtttcacctgatggtcactgcgtcccagatattccagtaccccgtcggcgcgccagcggaccaggtcgccggtgcggtacatgcgctcgccgggggcgccgtacgggcaggccacgaaccgttccgcggtcagcccggcccggcccacgtagccgagcgccagccccaccccggccaggtagagctcgccggtggcgccgggggcgaccgggcgcagcaggcggtccagcacgtacacctggatgttggtgatcggggcaccgatcggcacggtcaccgcgccgggttcggcccggcactgccacgcggtgacgtcgaccgaggcctccgtcggaccgtagagattgtgcagctcgacgccgggcagcagaccgaggaagcggtgctccaggtcgaccgggagcgcctcgccgctgcagatcacccggtgcagcccggtgcacccggccgcggccggctcgcgcaggaactcgccgagcatcgacgggacgaagtggagcgtggtgatccgctcctgccggatcagctcggccaggtaggccggatcccggtgcccctccgggcgggcgaccaccagggtggcgcccacctgcagcggccagaagaactcccagaccgacacgtcgaatccggccggcgtcttctgcagcacccgctcgccggggcgcaggccgtaacggtcctgcatccagcgcagccggttgacgatgccgcggtgcgggacggccacgcccttcgggcggccggtggagccggaggtgaagatgacgtacgcggtgtcgtccgctgtcaccggccgccgctccgccgcgctcagcgggtgcgccggcaccgcgtccaggtccagggtgtccagccgcagcgccgggccgggcaccccggggccgtcggtgagcacgcaggccggccggccgtcctcgatcatcgcggcgatccgggcggccgggtactccgggtcgatcggcaggtaggcggcgcccgtcttgagcaccgcgtacagcgcgacgaccagatcgaacgagcggggcagcgcgacaccgaccagccggcccggcccggcgccctcggcgagcagccggcgggccagccggttcgcccgctcgtccagctcccggtaggtcagggcggcgccgtcgtgacgcagcgcgaccgcctccggcgtccggccggcctgctcctcgaaggccgagaccagggtgccgccgggcaccccggcggcggtgtcgttccaccggtgcagcacgtcggcgcgctcggccgggctgagcgggtccaggtcgtcgaccgcgatccccgggtcggccgcgaccgcggtcagcacccggaccagccggtcgagcaggatgccggcctggtccgcgtcgaccacgtcgggccggtggccgaggcgcatctccagcccgtcgccggcggtgaccgccagccgcagcgggtagtgcgtggaatcctcgatgtgcaccccggcgacgcgcaccccggccgcggtcagcggcgccgtgaccgcctcgtggtcgagcgggaagttctggaacaccgtggtggtgtcgaacagcgcggggtgcccggtggcccgctgcacggcggccagcggggcgtggtggtgttcgatcatcgcggcctgctcggcctgcagccggaccaggcaggccgcggcggactcaccggcgcgcagccgcaaccgcaccggcacggtgttgagcagcagaccgacgatccggtcggcgccgggcagcagcggcgggcggccggagacggtggtgccgaagaccacgtcggcggagtcgagcagccgggacagcagcaccccccagccgaactggaccacggtgccgagcgtgacgccgtgccggcggcccaggtcggccagccggtcggtgacctcggccggcagcaccgcgcggacctcgtgctgcagggtggccggcaggtcggcggcctgtggggcatacagcgtcggactgtccagtccggacagcgccgcggcccacgcctgctcgctcggggcggtcgggtgccggcgcagccaggcgaggaagtcgcggaactgcggcgcgggcggcagcacgtccgccggcccggcggcgtagagggcgaacagctcacccagcgccaccggtaccgaccagccgtcccagagcaggtggtgcacggtgagcacgagccgctggcgtcccggtcggagccggagcagggcgaaccgcagcagcggcggccggtgcgggacgaacccggcggcccgctcgacgcccgcgatccgggccgcctcggcctcggactccgggccggcgagaccggtcaggtcgtgctcgctccacgcggccggcacgtcgcggtggatcagctgaaccgggcgcttgagcccggcgtggtggaatgccgcgcgcagcgacccgtgccgggcgagcagcgcgtcggcggccgtccgcagccgggcggcgtcgatctcgccgtccaggtcgagccggagctgggtggcgtagacgtcgacctgctcctggagagcgtgcagcaggaagccctcctgcagcggggtgagcggccaggccgcttcgatgccctcgggcagccgcgcgccgctcatttcgaccccacccgcaggtcggtccagtgctgctcgacatagcggacgcagtcggcccgatcggacggggccagcgccaccgaccagccggccggggtggtcaccgcggccggccagagcgagtgctgcccgcggtcgttgaccaggaccaggaagcgggcctcttcgtcgtcgaacgggttgctcatcgcgttcctcccgcggtcagctcggcggacagctccgccacgatcagccgggccagctgggccggcgcggtctcggtgtagaagtggccgcccgggatggtgcgggtcgagcagccggccaccgtgtgccgggcccactcgccggcgtggtcggtggtgaacgaggcgtcgctgtcccccgcgatcacggtgatcgggcaggtcagcggggcgccggtggcgtactggtagtcggcgatcagccggaagtcgccgcgcagcaccggcatcgccagctcgcgcaggtcggggtcggccagcatcccggcgccggtgccgccgagcgagtcgacgtagcgcaacaccgacgcgtcgtccgggaagcgcagcgactggttggtgcggtgcggggcgcggcgggccgaggcgaagaaccggcgcagcgcgttcgggcggcgggcgcgcagccggcgggccacctcgtacgccacggtggcgcccatgctgtgcccgaggaacgcggccgggcggtccaggcggtccagcatcgcgccggtgatctcgtcgaccagctcggccatcgtccggggcagcggctcgccgtagcggtcctggcggcccggatactgcaccgcgaccagttccaggtcgtccgggagcagcgcggcgagctggtggaacgagctggccgcaccgcccgcgtgcgggaaacagaagagggtgagccgtgcggcgggtcggggcgcgatcacacggaagcagtcacgcgccgctatgtgcttggcaacagtcatgagcggaataactctctgctcgtggccgaaaacggcccggtcccggacggcgatggccgtccgggaccgtactctgccggatacttctatatttattatcttttagcgagtctcagagtcagctcaccacggagacgtcgccgccaccggacttggccttgatcttgtgggcggagccggccaccgcctgcaccgacaccgtcttgttgccgccgtcggtggacgcgtccacctcgtacggcccggccgggaccttgaccttcacgtcgccgccggagctggtcacgtcgaccagcggggccggcgtcgcgtacgacagatcgatgtttccgccgttggtgttgaccgtggcgtcggcaccgaggccgctgccggtgatgtcgccgccgtcggtcttgatcttcaccacggtgccggccggtagttcgatccggtagtcgacgtggcagttgtccttgccgcagccgctgtcgaccaggttgagcgtgccaccgtccacactgtgcgaggtcttcggcttggcgtcgtcgtacttcagctcctcggagaccttgaccgaggcgccgtccgaggcggtgagcgtcacgttgccgccccggccgctcagcgacagcgtgctgaccttgtcactgatgtcgtacgtgttgtccgcgctctggtcggatccgctcgccttcgggtcgcacccggcggcgaacagcgcccccgtcgcgatcgccagcaggccggcggccaccttgatgttcctcatcgtcgtcactctcctcgtgcggtggcggccgcgtggctgaccagcacggcttcctcggtgggctcggcgtgggcggactcggccaccgggtcggacccggtcaccacggccgggcggccgcgcaggctccaggcccggtcgccgagcagggacagcgtcgcggggagcagcacgccccggacgatggtggcgtcgatcaggatggcgacggccatcccgacgccgagcatcttgtactcgatgccggagagcgtcgcgaacatcgcgaacaccgcgatcatcacgaccgccgcgctggtcaccacgccggcgctgctgccgacgccgtgcacgaccgagtccttggcggactcgccgcgggcccagcgctcccggacccggctcaggatgaagacgtggtaatccatgctcaggccgaacaggatcacgaacatgaacagcggcagccagttgaccacgccgccgaaggacgagaagcccagcagtccggcgaagccgcccttctggaagccgagcaccacgatgcccatcgcggccccgatcgccagcaggttgagcaccatcgagaccgcggcgaccagcggcgcccggaacgcgacgaccagcacgatgaacgccagcaccaggacgaaggcgaccacccaggcggtgcgctgctggagcacgtcggcgaagtcgtgcaggccggcggtgcggccgcccaccgcgtacttcaatccgggcgtgttcgcgaaggccttcggcaggacgtcggtgcgcagggtctccagcgccttcaccgaggtgtcgtcggtgccgctgccggccagcgggaccttgatgctgagcacgctgcccaccggggtggccgagatctggtcgccgagcagatcgctggcggccgcctcgcggcgcagctcggcgacggcctggtcggccgcgccgctggtggcgccggtgccccagaccaccacctgcgccgggtcggcgccgcccgggaaggcctgctgcagccgcacgccggcgtcgaccgccgggatgctgcgcggcagcgagtcgagctgaccgggctcgctgagcttcatgccgaaggccggcagggccagcgcgaccagcgcgatcagggccaggccaccgtagatcagcgggtgccgggacaccccgccggcgatcgccgaccagccgcgggagttggtcgccgtggtgcgcgagcggcccaggaagggcacccgcagcgagtcgacccggcggccgagcacgctcagcagggccggcagcacggtgaccgagccgagcacggccaggccgaccacgatgatcgtgccgatcgccatcccgttgaacgtgtcgacctgggccaggaacagcccggccagcgagaggatcacggtgaggccggagaccaccacggcgtgcccggaggtgcgcgcgctgatcttcagggcctcggtggcgctcttgccggcggcccgctcctcacgctcgcggcgcaggtagaacagggagtagtcggtgccgaccgccatgccgatcagcagcaccaccgaggagaccgtgctgttggccgggatgatcgtgccgaccaggtcgaggacgccgagcccggcgagcaccgcggtggccgccaggaagaccgggacggtcgccgcgaccagcgcgccgaagaccacgatcaggatgatcagggtgaccggcagggagagctgctcggcccgggacaggtcctcgtcggccgccttgttgaccgccgaggtcagcgagatgtcgccggccatcgcgagccggacgccggggtgcgcgccctggaccgcggtgatctccttcttgatgtcggcgaagtgcttgtccgcgtccttgcccggacccgggatggtgaagctgaccaggccggacttcccgtccttggagaccagcgcggcccgggtctgctcgttgtcgagcggggtgaccacggagctggtggcgccgggcagcgccttgatccgggcgctcagatcggtggcggcgctctccagatcgggagtgccgaggaacgacttgtcccggccctgggcctcgatcagcacgttttcggtgtaggacgaggtgaccttctgggcgcggatcatgctctgcgcctggccggcctcgccggcgtcggtggtcttggcgcccgagccggccgacccgccgaccagcaccgcgacggccaccagaagaatccagccgacgatgacctttttggggtgacgggctgaccagcccaccatccgctccaacagcagcatgactgtccttcctggatcaggggggagattggggaggggtctcagctcagctcgcgcatcatgcgctccatcgaggtcacggactggcggacgccggtgagctcgctcgccacccgctcgcgcatgtcctcgtgctcgaggagcagctcggcgtatttgtggttgagctcgcggtagtgctcgtcgccgcgctgggcgacgatccgggcccgccaggtggcggcggcctgggtgacgatcaggaccaggaccaggatgatcccggccacggccagcaggctggtgaggtcgttgccgtaagtcatcggccttctccttctcttgggcgagcctagggaatccgcggggctcggagcggtcgccgagacgcctcgtccggcaaactggggtgacccctatcaggtcggcccatcatgtgtaagacaaagcttacaggtgcctggtgccacccgtcaaagggaactgacaggtgcctggcggatggccggcagacacaccgccagcagcgccagcaggcccatcccggcggcggtgaccagggccgcgtcggacgtgctcacggcgctcagcagcaccccgccgagcagcgcgccgaccgagttcaggcccgagccgatcagcgcgaaaacactggtcacccggccctgcatgtgatccggggtgacccgcacctgataggtcgcggcggccacgttgagcagtgcgccgagcgccgccatgccgcccatcagcgcacccagcccggccggcagggtgatcaccgcgaccagcgcgatcagcaccgcccacagtgccaggacgccgatcaggatcgccgggatcggcagccggcgcatcacccgcgccgcacccagcgcgccgatcaggccgccggcgccgccgagcagaccgatcaggccgaccatgtacggcgggctccccccgtgcttgacgatcagcaccagggtcaggttgatcacctggaaggccaggttgctcccgcccaccagcaggatcgccgagcgcatgaagcggtgccgccacacccaggcgaagccctcggcgatctcggtggtcagcatccgccgcgcctgcggccggtcgtcctgcaggttcctgcgcacggccagcagggtcacgaaggccaccgcgtgggtgagggtggcgaacgcgaacggcagccaccggagagccgagtacagcgccgtcccgagcggctgcccgaccagcccggtggactggccgcgggcctcgttctgggacagcgcggcgcccaggtgctcgggctccacgacgtgccgcaccgaggcccgctcggccagccggtagacgatcaccgcgctgccgtccagaaaggcggcggccatcacgtgcggcagccagacccggccgagcagcatcgcggcgaccaggctgcccatcgcggccagcccgatcacgtcgcaggtcagcatggtgcggcgccggtcccagcggtccaccagggcgccggccggcagcacgaacagcagctggggcagcagggtggcgaaggcgaccagggaggcgtccgcgggtgagccgccgccccagatgatcagcagcgggaaggccgcggtggcgacccgggtgccgagcagcgaggcgccggccccggtccagagcatccggaaatcgcggttccggcgtagtggcgtggttggtttctcggagagtgcggtcatgacagggctcctgacaggggaacggccggccggctcgacacgcgaaccgaccggccgatttggacttcctagtggcggcgcagccgtgccacgacggccttcaccacctgctcccccgcctcgccgttggtcatcacgcacagcccgtcaccggagttcagcgagatgaccgacaggctgtggtagcccaccggggtgccggcgtgcccgaactcggtgctgtccaccaccgtgccgagcccgtaaaggctgtccgggtacggcgtgagcatcagttccgcggtctgccgccggagcagggcgagcggccggcccagcgccgagcgccgcagctcgatcgccacccgggccaggtcggccggggtcgaccagagaccggccgcggcggcgtcgggccggatccgccagccccccgcgatcggctcaccggcggtgtcgtgaccgtgcgccaccgggctcgccgcccgggccgggtagtcctggtcgaaactgctgtccgccatgttcagcggctccagcaccagccggcccatcagcgcgtcgaacggctccccggtgacgtcccgcagcacctgctcgatcaccacgtagtggacgttggccttgcggaacgacgcgcccgcctcggcgatccggctgaccgctccggccgcgccgtcgagcagcccggtcagcgacggcgccggctcacccgggacgaagccgccaccgggggtggaggacaggccggaccggtgcgccagcaggtgccgcagggtgaccggacggtccccggcgggcacccgccagccggccagataccggttgacgtcccggtccaggtcgagcaggccctcgtcgaccagccgcagcacggccagcgcggtgaggtgcttgctcagcgacccggcctggaacggggtacgcccggtgaccggcactccggccgcagcctgcccgaaggtctccacctcgaccaactcgccaccggccagcaccgcgacgctcagccccggcacgtggtgccgctccatggcgtcctgccagtcctggcgggagaccagaccgggcgcggtgaccggcggtgcggccttggtcgccgcggtggccgccagctgcgcgtccacctcctcggcgaccgccgccagggtgcggtgctggtacatcgcgaacagggtgagtggaagccccctgcgctgggccgccgcgaccgccttgatcaccaggatggagtggccaccgagggccaggaagccgtcgccgcggccgaaccgttcgactccgagcagctcggcgaagatctcggcgagaccgcgttcggtgtcggtggccgggggctcgaagtcgtcggacgacagcgaatgctcgggcagcgcgcctagctagctagcccggtgcccggctcggccggcacccggtgcacgcaggtgccgacgctggcctcggtcggcccgtactcgttgaccaggcgcccggcgggcgagtaacgcccggcgagcgaaccgggcagcgcctcgccggccaccaccatcacgccggccaggtcgctcacctgctccggggtcagctgctgggagagcacctcgaggtgacccggggtcagcttgaggaaggcgaacggtcccgccgagtgcaggcgcccgcccagctcggacaggtccagatcggggggcagcatctccaccggctgcccggccagcagcggcgcccagacgttgggcaccaccaggtcgaaggcgaccgaggagaagaccgcgccgccccggccgccgccgaccagggagccggccaccgccaggtcgcggaccgcccagccgacgtggttggccagtccgcggtgggtgaccgcgacgcccttgggctttccggtcgagccggaggtgaagatgacgtacgccagctcgtccgggtcgatctcggccggggtgaagctcgcctcctccagcgacgccaccgactcgtcggtgagcagcgccttggcgcccgccagcatggactccacccgggagtccgggaagcccgggtcgatcgggatgtaggccgcaccggtgaaccacaccccgagcagcgcggcatgcagccacggtccccgctcgacccgcacaccgacccggtcaccccgcccgaccccctgggcccgcaacgccacggcaaccgcaccggcccggccgaccagctcacggaacgacagctcgaagccctcgccgcggacggccagcgcgccgggcgtccgccgggcctgctcggccagcagcaccggcaccggtcgcgcggtcaccgcctcctcggccgggcgttcccagccggccaccacctcggcctcgccgaccggcaggaacaccccggtggcgtcgccctcggcgtcggcggccatcgcctccagcaccgcgcggtacatcgaggccagccgcgaggcgtgctcccgggacaccagccccaggttgcagcgcaaatgcagcaggcccggcccggtggagatggacagcccgaactcgttgctgctgtggcccaggctgtcgccgaccgccaccccaccatccaggctggagcccatcccggtgaagtcgtggaagctgaagtaggcctcgatcatccggccgccctcgccgtagctgcgttcgatctgcggcatcgggaagtgccggtgcgcccacacctcccgttcccgggcgaaggtggccgcgaccagctcccgccaggtccgcgcgccccggtcgtggcgcagcggcagcacgttgaggaacatgccgtgcacccggtccgcgtcggccgactcgggccggacgtgatgggtcagcccggacaggaaggagcgctccggagtcagtccgccgagcacggtcaggtgtgcggccagcagcgtgctcttcatcggggcgccggcccgggcggccaccgcgcgcagcccgtcggtcaggtccgcgaacgggatgtccagcacgatcgtcccgcccggctcctcggccggcgcgccccagttcgccggaagcgcgaaccgtgggcagtcggccacctgcgagcgccagaactcctgctcctgcggggaggccagggccgcgagctcggcggcgaccgtgtcggcgaagcgcaccgacggcggggcccagtcgtcccggccgtggtagagctcgaagagctcgacgaacagcgtccgccggctccacccgtcgagcaccacgtgcgagttgatcgcggtcagctgccagccgtccgcgcagtggtgcacggccagcttgagcagcggcgggccgtccgggtcgagcggcaggcgcccggcctcggtcacgaaccgctcgatcgcggccgccgcctgcgcctcggtgagcgcggtcagatcctcgaccggcacgtgtaccggcacctcggtgtgcaccagctgcatcggcaccgagtagcggtccaggctgacgctgctgcgcagcacgtcgtggcgctgggcgagccgggccgcggcggcccggaaacgctccgcgtcgaacggccggtcgtcgcggatccgcacgctggtcaccacgtggtacggcgggtgctcgccgccgaccagcatctccacctgcatcccggtctgcgccatgagcagcgggtacgcgtcgtccagcccggccggcagcagagcccggtcggcctcgccgagcagcgcgaacggccgcaccggcgggggcggcgtcgggccgcccgcccgccggctcagcagcgcgcacaggtcacccagcaccggataccgcatcaggtccttgacctcgaccgcgaagccgtggtcccggagcgtgccgaccagcaccacggcccggatcgagtcgccgccgatgtcgaagaagccgtcggtgacgccggcccggtcgatgccgagcaccgcctgccacatctgcgagaccgaggcctccagcgggctgcgcggggcgacgtactccgccgcgccgcgccactgctcggcggccggctcgggcagcgcccgcttgtccagcttgccgttggtggtcagcgggatcgccgcgatcgcgacgaacgcggccggcaccatgtactccggcaacgtccgggcgagggtctcgcgcaccacccgcacgtccggcgccgcttccccgtccgggaccaggtagccgaccaggcggccgtcggtggccaccacggtgaccgcctcgcggaccccgtcgcaggcggccgccgccgcgctgatctcgccgagctcgatccggaagccccggatcttgacctggtcgtcggcccgcccgacgaagtcgtacgtgccgtccggacgctgctgagccaggtcgccgctgcggtacatgcggctgcccggggcgccgagcgggtcgggcacgaaccgttgcgcggtcagcgccgcccggcccaggtagccgcgggccacgccgggcccggccacgtggatctcgccggtgaccccggccggcaccggccgcccgtcctcgtcgagcaggtggatgaccaggtcggagagggggcggccgatcgggttgccggcgccggcggccaggtcccgcttggtgagccggtggtacgtggtatgcacggtggtctcggtgatcccgtacatgttgaccagcgccacccggcccaggccgacctgctcgacccacggcttgagctcggcgacctccagcctctccccggcgaacaccaccgcccgcaggctgagcagcttgatccggcggtccttggcggccgccgcggtgatcaccgagcggaacgcggtgggcgtctgggacaacaccgtcacctgctggtcgaccagcaggttcaggaagtcctcgggtgagcgggacacgtcccgcggcaccacgaccaggcggccgccgaaggccagcgcgccccacatctcgaagaccgacacgtcgaaggcgtacgagtgggccatcgaccagacgtccgcgtcgtcgaacgcgtagtgctcctgcgcggtgtccagcagccgggtcacgttgcggtgggtcagcaccacacccttgggccggccggtcgacccggacgtgtagatcgtgtagatcacgttgtccggagtggacacccgcggcgggttgtcggtccggccctcgcccgcctcgtcgaccaggatcacccggccctggtagacctcggccagcccgggcgcgagctccgccgaggtgaccacgatccgcgcgccggcgtccgccagcacgtatccgagccgctcccgcgggttcgccgggtccagcggcaggtaaccggcacccgacttgagcaccccgagcagggtcgggaccaggtccacgtcccgctccaggtgcacgccgatcaggtcctccgggcccgccccggcgtcgcgcagccgccaggccagccggttggcgcgggtgttgacctcgtcgtacgacagctcgatgtcccccgcgacgaccgcgaccgtgtccggttgcgcggccacccgggcctcgaagagctcatgggcgagcgttccctggtcaggttcctctgcggcgaccggcacggtcgtctcctcgtcgagtccggcggcgatcgcggtcaggaccgaccggtacatcgccgcgagttgttccgcgtaccgcggggcgagcagcccgctgtcggtcgcgatgccgagccggcggtcgccgtgcgcgtgcaccgagagaccgaagtcgttggcccgctggttgaccgccacgccctggtcgacgacctcgccgtcgacctggtggaagtcgatgtagttgaagagcacgtcgatcagccgacccccggtggccgcgtcccgctggatccgggagagcgggtactgccggtgcgcccacacctcggtctcctgctcgaagaccgcggtgagcagctcgcgccaggtgccggcgccggcccggtgcgggaacggcagcgagttgaggtgcatgccgagcacccggtccgcgccgaccgcctccggccgcccgtggaacaccacgccggtgtggaaggccggcgcgtcggtgatccgggagagcacctcgaggtgggcggcgagcagcagggtcttgaacggcaccccggcctcggccgcgcgggcccgcaggtcggtggcgaggtcgtcgatcggaactcccacgctgtacggctcggcgtccgccccggccgtcccggcccatccgaccggcaggtcgaagcgggcatgccggtcgacgacgcgccgccagaacgcggcgtccgccgggtcgcgcagcgacgccagctcgcctgcgatgacgtcggcgtaccggaccgccggcggctcgtatccggccggcgcgccgctgtcccggatctcccggtaggcgttcgccagctccatctcgaaggtggcgctgctccagccgtcggtgatcacgtgcgagtaggtgatcagcagccaccacgaggtgtcgctctccaccagggcggccagccgcatcagcggcgcggcccggaagtcgagcacgtcggcgcgctcggcctcgacctcggcggtgagcagccgctccccctcggcccgggccacgccgcgggcgtcgaccacccgcaccggaacggtggccgcggcgtgcacgatctgcagcggggtggagtagccggtgaggtgcaccgacgtccgcacattctcgtgccgtgcggtgatcacctcgacggcccgccggaaggcggcctcgtcgaacggccggtcgtccctgatccgccgggccgcgacgttgtggtagacccgcttgtcaccgctggcgtagtgctcggccaccatgcccagctggacctcgcccagcgggtaggcgtccgccgtgccggccggcagcagtgcccggtcggccgcgctgatcagtgcgaacggggcgaccccgggggccggcgcctccgccgtgatacccctggtctccagcaccgcggccaggtcggcgaccgtacgctgcgcgaagacgtcgcgcacggtcaggtcgtagccgcggccgcgcagcgcgccgaccaccgcgaccgcccggatcgagtcgccgccccgctcgaagaagcggtcgtcgcggcggatcggggcggtgttcaacgcccgctcccaggcctcggcgacggcggtctcgaccgcggtcatcggggtgtcgtcggtggacccggcggcctccggcgcgtactccggcagggcccctagctagctaggccggtgcccgggtcggccgggaccggataaatgcaggtgccgacgctggcctcggtcggcccgtactcgttgatcagccggccggagccggagtaccggccggccagcgcgccgggcagtgcctcacccgcgaccaccatccggccggttaggtcacgcacctgctccgggctcagctggtgggagagcacctcgaggtggcccggggtcagcttgaggaagctgaacggcccggccgcctgcagccgcgcgcccagctcggacaggtccaggtccggcgggaggagcaggatcggctggccggccagcagcggcgcccagacgttcggcaccaccaggtcgaaggcgaccgaggagaagaccgcgccgccgccgtcaccggccgacgcgaggtcccgcaccgcccagccgacgtggttggccagtccgcgatgcgacaccgcgacgcccttgggctttccggtcgagccggaggtgaagatgacgtacgccagctcatcggggtcgatctcggccggcgtgaccgccgcctcgcccagggccgccaccgactcgtcggtgagcagcgccctggcgcccgccagcatggactccacccgggagtccgggaagcccgggtcgatcgggatgtaggccgcaccggtgaaccacaccccgagcagcgcggcatgcagccacggtccccgctcgacccgcacaccgacccggtcaccccgcccgaccccgtcggcccgcagcgccgcggcaaccgcaccggcccggccgaccagctcggcgaaggtcagctcgaagccgtcgccgcgcaccgccggggcgtgcggcgtccgggccgcctgctcggcgagcagcaccggcaccggcacgtcggtgaccgtaccgtcggtggccggttcccaggcggtgattcgctcgtcgtcgccggccggcaggaacaccccggtggcgtcgcccgccgggtcggcggccatcgcctccagcaccgcgcggtacatcgcgccgagccgttccgcgttcgcccgggacagcagcgaggtgcgggtcttcagggtgagaccgccgttggaggtggtgacggtcagcccgaactcgttggagccggagccgaacccggcgctcaggtcgatcttctcggcgtccaggttgtggaagtcctggtagttgaagatcacgtcgacgaggcgtccggagccgccggccagccgggacaccccggccatcgggaaccggcggtgcggccagagcgccacctcggcgtcgaagaccgcgcggaccaggcccgaccaggtggccgcggaccggtcgtacgggaccggcagggtgttgaggaacatcccgtgcacccggtcggcgccgagtacctccagccgggtgtcgcagaccagcccggcgtggaaggccggctcgttggtgagctggctgagcaccttgaggtgggcggcgaacagcacgctcttgaccgacgcccgggcctgggtggccagcgcgcgcagcgggacctccaggtccatggccggcacggtgagctggtaggcctcgtccggcccgtcggcgtcaccccaggtggcgggcagccggaacggcgcccggtcgtccaccacgccctgccagaaggcccggtccgcgggcgactccagggcggcgagctcggccgcgacggtgtcggcgaaccggacctcgaccgactccggccgggccggggcacgcccgtcacggaccgcgcggtagcactcgaccagctccatcagcatctcgtgctgactccagccctcggtgatcatgtgcgaccgggacagcgcgagccaccagccgtcgtcggcgaccagtgcgccgagccgcagctgcggcaccgcggccgggtcgatcggccgggcctgctcgcccgccacgtgctcacgcagcgcggcgtcgagcgcctcggcgtccaacccacgcaggtcgaccacgccgaccggcggctcggcccgctcgtgcaccagctgcagcgggatcgagaaggtggacaggtcgaacgacgtgcgcagcgcctcgtgacggccgcagacgacgcgtaccgccgcctgcagggcctcggggtcgaacggcgcgtcgtcgatcaccttgtagccaccggtgctgtggtagtgcgccacctcgccggcctccagctcgaagagcatgccggcctgcgcctggagcatcgggtacgcgtcgctcaccccggccggcaccagtgcccggtcggccgcgccgatcagcgcgaacggctcgaccgcccggtgcggccgggccggcgcggtgcggctgccgatcagctcggccagcccggcgaccgtgcgccgctcgaacacgtcggtgaccgagacgtcgtgcccggccgcccggaccgcgccgaccagcgacaccgcccggatcgagtcgccgcccaggtcgaagaacgagtcctcgacaccgacctggtccagacccagcacctgcccccagatcagcccgagctgctgctcgagcggggtccgcggggccaccgtggcgatcgccgccgaggtgctgtccggggccggcagcacccgcttgtccagcttgccgttggtggtcagcgggatcgcgtcgatctccaccagggcggccgggaccatgtagtcgggcagggtgcgggccagctcggcgcggatcgcccgcgggtcggtccgctgcccggcggccggcaccaggtagccgaccagccgcttgtcgccgggggtgtcctcgcgcagcacggtgaccgcctgggcgaccccgtcgcaggcggagagcgccgcgctgatctcacccagctcgatccggaagccgcggatcttcacctggtcgtcggcccggccgacgaactccaggcgaccctctgaggtccagcgggccaggtcaccactgcgatacatccgggtgcccggcgcgccgaacgggtccggcacgaaccgctgcgcggtcagcgccgcccggcccagatagccacgggccacgcccgggccggccacgtggatctcgcccggcacgccgaccgggaccggctgaccggccgggtcgagcaggtagacggccaggtcggcgagcgccaccccggccgggctgaccgaggggttcgccaggtcgccggagtccacctcgtgcaccgtgacgtggaccgtggtctcggtgatcccgtacatgttgaccagcgccacctggccggcccacgaggcgacctcgccgacctccagcttctcgccaccgaagacgaccgagcgcagcgccagatccgccggccgcggcgcctgggtgagcgcccggaacgcggtcggcgtctgggacagcacggtgacccgctcgtccgccaggagccgcaggaagtcttccggcgagcgggccacaccgcgcggcaccacgaccaccgtgccgccgaacatcagcgcgccccacagctcgaacaccgagaagtcgaacgcgtacgagtgcatcatcgaccacacgtcgtccgcggtgatgtccagttcggactcgcagacccgcatcagccggacgacgttggcatgggtcaggacgcagcccttgggccgtccggtcgacccggacgtgtagatcgtgtagatcacgttgtccggcgtcgccaccgtgggcgggttgtccacccggtcgtcgccggcgatctcgtcgaggatgatcaggcggccgtcgaacacctcggccagggccggggccagctcggccgtggtcaccacgatgtccgcgcccgcgtcgttcaccacataaccgagccgctccatcgggttcgccggatccaacggcaggtagccggcccccgacttgagcacccccagcagggccgggaccaggtcggcgccccgctccaggtggacgccgaccaggtcctcgggacccgtccccgcgtcgcgcagcagccacgccaggcggttcgcccgggcgttgacctcggcgtacgacagccgggacgcccccgccacgacggcgatcgcgtcgggggtctccgcgacccgggcctcgaacagctcgtgtgcgagcgcctcggccccgggaccgggcaccggtgggatcaccacggtggcgcgctcggccgcggacagataggtggcccgggcgtcgccccggtcgccgtcggcggccatgctctccagcacggcccggtacatggcggcgatccggtcgatgttctcccgggacagcaggtgggtgttgctgcgcaggccgaggacgccgccgatggcggtcaccgccagcccgaactccatcgcggtgcggttgatcccgttgccctcgtccaccacgtcgccgtcgtcgagcaggtggaagtcgaggtagctgaagaacgtgtcgatcaggcgggagccggccgacgcgatcgccggcatcggatacgcccggtgcggccacgccgcggtctcgtcggcgaacacccggcggaccaggtcgccccaggtggcggcgtcccgggcgaacgggtgcggcagcgtggtgatgtacatgccgatcagccgctccgcgccggtcacctcgggccgcacgtgcccgaccaggccggtgaagaacctctccgcgccggtcagctggctgagcaccttcaggtgggcgccgagcagcaccgccttgaacggcaccccggtggcggcggccaggtcgcgcaggcccggctccaggtccgcgaaggagaacccggcgtcgatccgctcggccggcgcgcccaggtcgccgtgccagtcctcgggcagggccagcggctcgtactcgccgaccaggccgtgccagaagtcccggtcggcgtcggaggcgagcgaggccacctcggcggcgaccgtgtcggcgaaccggaccggcggcgcgtcgtaccggatctcggcgccgtcgcgcagcgcccgcaccacctccaccagctccttgagcagctggtggtaactccagccctccaacagcgcgtggctcttggtgaacgacagccgccacgcccggtcggtctgcaggtgcacggtgatccgcagcagcggcagcggcgaggccaggtcgaacgggttggcccgctcggatgcggcgaacgccaccagccgctcgtgcaggtcggccggcgccacgtcgcgcaggtcgtgcaccgccaccgggatggtgacctcgtgatgcaccagctgcatcggcacccggtatccggtcaggtcgaccgaggtgcgcaggatgtcgtggcggcgcccgaccagctcgaccgcctgccggaacaggccggcgtcgaacggcgcgtcgtcgcggaccaggaacgacgtgaagtcgtggtagttggcctgcgcgccggaggcgagcgtctcgaccagcatgccggtctgcgactgcagcagcgggtacgcgtcgtccagcccctccgggagccgcgcccggtccaccgcgtcgatcagtgcgaacggcgccaccgagcggaccggggtcaccggcaccggggcgccggtcgccgacgcgcacagcgccgcgaccgtggtgtgctcgaagacgtccagcacgccgaccgcgaacccggccgagcgcagcgcgccgaccaggctgaccgcccggatcgagtcgccgcccagctcgaagaagtcgtcctcgacgccgacccgctccagcttgagcgcgtgcgcccagacggccgccatccgctcctcgtccggggtgcgcggggcgacgtagcggtcctggtcgtacgtctgctcgccgggggcgggcagcgcccgacggtccagcttgccgttggtggtcagcgggatcgcgtcgatctcgacgaacgccgacggcaccatgtactcgggcagcgtccgggagatggcctcgcggatcgcccgggtgtccagcgtcgcgccctcggccggcaccaggtagccggccagccggccgtcggcggccaccacggtgaccgcctcgcggaccccgtcgcagccggccagcaccgcgctgatctcgcccagctcgatccggaaaccgcggatcttcacctggtcgtcggcgcggccgaggaattccagggtgccgtccgggcggcggcgggccaggtcgccgctgcggtacatccggctgccggccgggccgaacgggtccggcacgaaccgttgcgccgtcagcgccgggcggcccaggtagccgcgggccacgccgggcccggccacgtggatctcgccggtcaccccggacggggccgggtgcccggccgcgtccagcaggtagacggcgaggtcggcgagcgggtcgccgacccggttcatcccggggtcggcgatgtcctgcgcgtccagccggtggtaggtggtgtgcacggtggtctcggtgatcccgtacatgttgaccagcgccacccgctgcaggccgacccggtcgacccacggcttgagctcggcgacctccagcttctcgccggcgaagaccaccgcgcgcagggccagccggtcgatccgcgggtcgccctcggcggccgcggtgaccaccgaacggaacgcggtcggggtctgcgacagcacggtgacccgctggtcgagtaggagctgcaggaagtcctcgggtgagcgggccacgctgcgcggcaccacgaccaggcggccgccgaaggccagcgcgccccacatctcgaagaccgacacgtcgaaggcgtacgagtgggccatcgaccagacgtccgcgtcggtgaaccggtagtggtcctgcgcggtgtccagcagccgggtcacgttgcggtgggtcagcaccacacccttgggccggccggtcgacccggacgtgtagatcgtgtagatcacgttgtccggtgtggacgcccgcggcgggttgtcgaccctggtcccgtcgatttcgccggccaggatcacgtcccccgggtagacgtcggccagcccggacgcgagcgcctcggaggtgaccacgagccgcgcgccggcgtccgccagcacgtaaccgagccgctccagcgggttcgccgggtccagcggcaggtaaccggcgcccgacttgagcacgccgaggatcgtcggcagcaggtccgggccgcgctccaggtggatgccgaccaggtcctccggacccaccccggcgtcgcgcagccgccaggccagccggttggcccgggcgttgaccgcggcgtacgacagctcgacgtcccccgcgacgaccgcgatcgcccccgggttggccgcgacccgcgcctcgaacagctcgtgcgccagcagatcggccgagtcccgcggggccggcggcgcggtgaccgcggcccgctcggtcggcgacaggtacgccttgagcgcgtcgccgcgctccccctcggcggccatgctctgcagcaccgcgcggtacatcgcggccaggttgtcggcggccgccggggtcaggtggcggcggttcgcggtcaggatcacgtatccgccgcgggaggcgacggtcagcgggaactcggtcgggctgtcgtccatgcccgacgccgcgtcgaccacctcggtgtccacctggcggaagtcctggtagttgaagtacacgtccatcagccggccgctgcccggccactcgcgcagcaccgcgggcagcgggaaccggcggtgaccccacaggtccacctcggcggcgaacaccccgcggaccaggtcgccccaggtgcgggcgccccgggtgtgcgggaacggcagggtgttgaggaacatgccgtacacccggtcggcgccggtcacctcgggccggacgtcgcagaccaggccactgtggaacgactcctcctcggtcagctggctcatcaccttgagatgggtggccagcatgatcgccttcagcgaggtgtcggtcgcggcggccagcgcgcgcagcccggactccaggtcccgccaggagaagccggtcttgtacggcgatccggccaccgcctccgggtcaccccagctgaccggcagggtcagtggggcgtgcgcgcgcaccacaccacgccagtactcccggtcgccggccgactccagggcggccagctcaccggcgatcgcgtcggcgaaccgaacccgcggcgcctcgggcgtctccgggacctccccggcgctgagcgtcaggtaggtggtgacgaactccatcagcagcgagtggtagctccagccctccaggatcggatggcactcgaccagcgagatccaccagccgcccaggtcggtggggtgggcgtggaagcgcatgaggccgggcacgctcaggtcgaacgggtgcgtgcgctcccgcgcgccgaacgccgccacctcctcgcggacctgctcggcggtcgtcccggtggtcgcccagacgtccgtggtcatctccgcgtgcgcgtgcaccagctgcatcggccgggagtacgcggtcagctcgatcgaggtgcgcagcgcctcgtgccgggccaccacgatccggccggcctcggtgaacgcctccggcgagaacggccgctcgtcgtggatccagtacgccgagacgttgtggtagttgttctgcccgtcgtcggccagcatctcgatgaccatgccgagctggttctggcccagcgggtaggcgtccacgacgccctccggcagcagcgcccggtcggcctcgtcgatcagctcgaacggccgcaccggccggtccaccgcgtcggcgccggcctcaccggcgaactcgatcagccgggccaccgtgcggtgctcgaacacgtcccggacgctgacctggtagccggcctcgcgcagcgcgccgaccagggcgaccgcgcgcatcgagtcgccgcccagctcgaagaagctgtcggtgacgccgaccgtgtcgacgcccagcaccgccttccagacaccggcgacgtcctgctcggtggcggtgcgcggcgcgacgtactcgccggcggaccggagctgggcgccgtccggggcgggcagcgcgcgcttgtccagcttgccgttggcggtcagcgggatcgcgtcgatctcgaccagggcggccgggatcatgtagtcgggcagggtgcggcccagctcggcgcggatcgcggcgcggtccacggcgtcctcggtcaccaggtagccgacgatccgttccgcgcgcagcaccgcgaccgcgtcgtggacgccggcgcaggcggaaagggcggcgctgatctcacccagctcgatccggaaaccacggatcttgacctggtcgtcggcccggccgaggaactccaggcgaccctgggagttccagcgggccaggtcaccactgcggtacatccgggtgccgggagcgccgaacgggtccgggacgaaccgttgcgcggtcagcgccgcccggcccaggtagccgcgggccacgcccgggccggccacgtggatctcgccgggcacgccggccgggaccggctgacccgagcggtccagcaggtagaccgcgaggtcgggcagagccaccccggccggactgatcgccggcgtggccaggtcggccgcggtgagctcgtgcaccgtgacgtggaccgtggtctcggtgatcccgtacatgttgaccagcgccacctggccggcccacgaggtgatctcgccgacctccagcttctcgccaccgaagacgaccgagcgcagcgccagatccgccggccgcggcgcctgggtcaggccccggaacgcggtcggcgtctgcgacaggaccgtgacctgctcgtcgaccagcagccgcagcaggtcctccggcgagcgggcgacctctttctcgacgaggacgaccgtgccgccgaacatcagcgcgccccacagctcgaacaccgagaagtcgaacgcgtacgagtgcaccatcgaccacacgtcatcggcggtgatgtccagttcggactcgcagacccgcatcagccggacgacgttggcatgcgtgagcatgcagcccttgggtcgtccggtcgatccggaggtgtagatggtgtagatcaggttcgccggggtggcgaccacgggcgggttgtccacccggccgtcctcggccagctcgtccagaatgatcagccgcccgtggaacacctcggccaggccgggcgccaactcggccgacgtgaccacgatgtgcgcgcccgcgtcgttgaccacgtaaccgaggcgctccatcgggttcgccgggtcgagcggcagatagccggcccccgacttgagcaccccgagcagaaccgggaccaggtcggcgccccgctccaggtggacgccgaccaggtcctcggcgcccaccccggcgtcgcgcagcagccatgccaggcggttcgcccgggcgttgacctcggcgtacgacaatcgggagtcccccgccacgacggcaaccgcgtcgggggtgcgttccgcgaacgtctcgaacaactcgtgcgccagcacgtcgacctcggggctggccaccggcgggaccacgaccgtggcccgctcggccggggacatcacctcgatgtgcgcgaccgggaccgacgggtcggtcaccgccgcgctcagcacccgctggaacgcggtggccagccgggcggcggtggccgggtcgaacagcgcggtggcgtactgcaggcggccgtggatggtgccgtccggccgctcctgcatctgcagggtcaggtcgtacttggcgatgccgtcctcggcgccgaacggctcggcggtcaggccggcgaactgcagcacgtccaggcggtactcgtgcagggtgaacgcggtctggaagatcggcgtgcgggactggtcgcggtccggctgcagctcgtcgaccaggcgggcgaacggcaccgcgtggtggtcgaaggcgtccagcacggtggcccggccgcggcgcagcaggtcggcgaaggagctctcgccgtcgcactcggcccgcatcaccagggtgttgatgcagtagccgaagacccgctgcaggtcggcgtgcgcccggccggacaccacggtgccgaccgcgacgtcgtcgctgccgctgaacttggccagcatcacctggtacgcgctgagcagcacggtgaacggcgtggtgtcgaactcacgggcccgctcccggacccggtcgccgagcgcggccggtacgtcgaagaccacgtcggcgccgtcgtgggtgcgcaccggcggacgcggccggtcggtcggcagcgtgatcggctccaggccggacagccggctccgccagtaggccaggtcccgctcgccgcggtcgccggcgatctgaccgctctgccactgggcgtagtcggcgtactgcaccgggacgtccggcaggaacagcccgtccccgcggagcaggccgttgtacgcggcgctcagctcggccccgaacatccgggtcgaccaggcgtcacaggccacgtggtggaagaccacggccagcacgtggtggtcctcgccgaggcgcagcagcgctccgcggaccggccattcggcggccaggtcgaacggcgcctgcaggtcccggcggatcaacgccatcgcctcgtcgtcgcgcagcccgtccggcacgtcacgcaggtcgatctcgggcagcccgaccggccgtgggtcgtcgatcacctggaccggctcgacgccgcgcagctcgatccgggtgcgcagcacctcgtgccgggcgcagacgtgctgccaggcctggcgcagcacgtccacgtcgagcgggccgaggagccgcatcatcagcggcaccaggtactcggtgctgttcgggtcgagccggctgaggaaccacatctgctgctggccgtggctcagcggcagcgtcgcactgcgatcggcgcgcgggatcccgtcccggcggacgccgcccgactgcccggcgagccgcttgcgcagcagctccgcccgcagttcggaggtgctcagggtggactgctcgctcatgcctgcggctcctcgctcagggtgaggtccgcgacgacctcggaatcggacatctgctcgatctcgtcacggatcaggttctcgatcagctgggccatctcgaccacggtcgggccctcgaagacggcgcggacgggcagcgtgacgccgaactcgtcctggatggcggcgatcaaccggatcgcgatgatcgagttgccgccggcgtggaagaagttctcccggggaccggccacgatcccgcaccgttcacgccagagctgctggacgaactcggcgaccggggagagcggctcggcgtcccggctctccggccgcggggccgggtcgggcagcgcggcccggtcgaccttgccgttggcgttcagcgggatcgccgcgatcgacaggaacgcggccgggagcatgaagtcgggcagcagaccggcgcagtgctcgcgcagctcgtcgtcgccgaccggctccggcccgaccggcacccagcaggccaccagccgtttcaccccgccctggtcgtcgaccaggatccgggcgtcggccaccccggcgtgctcgcgcagcaccgcctcgatctcgccgatctccacccggtaaccccggatcttgacctggtcgtcgaagcggccgaggaactccaccgcaccgtcgccgcgccagcggaccacgtcgccggagcggtagagccgcgagccggccgggccgtacgggtccggcacgaaccgggccgcggtcagcgccgggcggtccacgtagccgcgggccacgccggtgccgccgacacagagctcgccgagcccgccgaccggcacctggaggagccggtcgtcgagcacccgcatcaccatgccgggcagcggcgagccgatcggcaccacgccggtgcccggatcggccggcaccgggtggatgcaggtgcccacgctggcctcggtcgggccgtactcgttgatcagccggccggacggcgagtagcgggcggccagggtgccctgcagtgcctcgccggccaccacgatgcggccggccagatcccgcacctcgcccggggacagctggtgggacaacacctccagatggcccggggtcagcttgaggaagctgaacggcccggccgcggtcagccgcgagcccagctcggccaggtccaggtcctgcggcaacaggtggaccggccggccggccagcagcggcgcccagacgttcgggacgaccaggtcgaaggcgaccgaggagaacaccgcgccgccgccgtcaccggcccgggccaggtcacggaccgcccagttgacgtggttggccaggccgcggtgggtgaccgcgacgcccttggggcggccggtggaaccggaggtgtagatgacgtacgccagttcgtcggggtcgatggcggccggcgcgacggcggccggcaccagctcctcgagcacggtgaccggcccgtcgaagaccccggcccgggacgcgtcggtgaccagcgcggcggcgccggccagcatcgactgggccctggtcaccgggaagtccggatccaccgggacgtacgcggcgccggccagccagacgccgagcagcgcggcgtgcagccacgggccacgctcgaccagcacgccgaccaggtcgccccggcccaccccggcggagcgcagcgaaccggccaccgcgccggcgcggtccagcagctcggcgaaggtcagcgcgaagccgtcgccacgcaccgcgacggcgtccggcgtccggccggcctgctcgaccacgccggccggcacgagtccgccgtcgatcgccggctcgccgcggctccacagccgcaggtcgtacgcgtcctggtcggtcagcgtgtccagcagccccagcggggtgcccggggcggcggccgcctcggtcagcgcgtgctccagggtggccgcgatccggtccgcggtctcctcgtcgaacaggctggtggcgtactccaggccaccgaccagcccgccgtccgcggtcgggcgcagcagcagggtcaggtcggtgtgggtgacccgccacatctcccggatcgcgcccaggtcgtcgtcgacggtctcgttgaagtccgccccgtgcaggtcgaaggcggcctggtagagcggggtgcgggacaggtccggctcggggaccagccggtcgaccagcacgtcgaagggcagctcctggtgggcgaaggcgtcccgggtgaccgtgccgagccgggccaccgactcggccacgccggccgccgggtcgagccggcagcgcagcaccaggttgttcaggaagaagccgaccacgccgtccagctcggctcggccgcgcccggccaccacggtgccgatcgggatgtcccactggccgctgaaccgggccagcacggtggcgtagagcgccaggatggtggtgaaccgggtggtgccggcctcggcggcgagcgcgtccagcgagcggaccagcgccggcgcgacggtgatcgggacgatcgagcccctgccgtcgcggacccgcgggcggggccggtcggtggccagggtcagcggctgcagcccgtccagcacggtcgaccagtagctgagctcggcctccaccacctcgtcggtgagccggtcgcgctgccaggcggcgaagtccgcgtactgcaccggcagcgccggcagcgccgggctgcgcccggccaccagcgcgccgatcacctgggcgaactcgcgctccaacacggcggccgaccagccgtcggtggtgatgtggtgcatcgcgacggcgagcaggcggcggccgtcggcgacgtccagcaccaccgcgcgcagcagcggctcgtcgccgcccagcgcgatcccgcggcccagcaggtcggccagcgcgtcggccaggccggccgggctgacctgctgctcggccacctcgatgagcacctcggggcggatgaactgacgcggctcgccggccacctcggcataccgggtgcgcagcgactcgtgccgggccaccaggacgttcagggcctgctcggcgagggtccggtcggcgccggccgggagccggaacagcaggccggccatccactccgggctggccgggttgagccggtccatgaaccacaggcgctgctggccgctggagagcggcaccccgccgccccgcgggacccggggcagcgcggcgccgacccgggcgtcgtcgagcagacgggcctgggcgagcagggtgggtgcgtagagcagcgagcgcaggctgaggtcggcgccggtctgtccgcgcaggtcggacagcagtttggtgagctgcagcgaggtgccgccgagccggaagaagtcgtcctccagggtcagctcccggccctctactgtggacccgaggagatgctgccaggcgttcttgaccagcagctcggacggggtggccgggaccgcgccggtgcgtcggtcgtcggccccggccgcgtccgggtggggcagcgcgcgacggtccaccttgccgctggccacctgcggcagcgcggccaggtggacgaagcggccgggcacgtgcgacgggggcagcaggtcgagcaggtgggtacgcagcgcggcgtccagttcgcggccggccgcaccgcgcggcacgacgtaggcgaccagccgggccgcgccgtccgccaggcggtacgtggtgaccgcggcggccaccacctccgggtgggtggccagggccgcctcgatctcggccggctccagccgcaccccgttgaccttcacctggtcgtcgagccgccccaggtactccagctgcccgtcggcacgccagcggacgccgtcgccggtgcggtagacccggccgccgtccttggccagcgggtcgggcaggaaccgctccgcggtcagccccggccggccgaggtagccgcgggccaggccggcgccgccgatcagcagctcaccggggacgccgacgccgaccacccggccgtgctcgtcgaccacctggacccgggtgcgcggcagcggccggccgatcggcaccgggccggtcgtctgggcgggatcgacccgggtggcgatcgagttgatcgtggtctcggtgggtccgtagacgttccacaccaccacgccggggaccagccggcgcagccgctcgaccggctcggcgtgcagttgctcgccgcccgagacgacggtgcgcagcgtgccacagccggcccagccgtcctcctcgaccagcgtgtgcaggatcgacgggacgacctgcagcacggtgaccgcgtgctcggcgatcacccgcagcagggtggccggggcagtgtcgccggccggggcgagcaccagggtgccgccgcgggtcagcggggcgaagatctcgaaggcgtgcgcgtcgtagaccagtgaggtgcgctgcagcacccggtcgcccgccccgatcccgacgtccccggtcgcccagccgagcaggttggccaggccgccgtgggtgaccacgacgcccttcgggacgccggtcgagccggaggtgtgctcgacgtacgcgatgtcgtcggcgccacggtcgaccgcgggcgcggtggccgggtgcccggccgccgcgctcaggtgcaccggctcggcgccggccgtggtcacccggacggcgtccgccgggtcgcagagcacgagcccgcagccggaggcggtcaggatgccggtcagccggccctgcgggtgcgtcgggtcgagcgggaggtaggcggcgccggcccgccagatgccgagcagtccggcgatcaggtcgaggccacggccgagcagcaccccgacgtgggtgcccgggccggcgccccgctcccgcaggtgatgggcgaattgtgcggaacgggtgtccagctcccggtaggtcagccgccggacgccgtcgacgacggctacggcgtccggcgtgagcactgcctgggagccgatgagctcaggcgtgagcgccgtagtggcctgggtgctggtcggcgagttctggtgcatggcagtgcgtctcctcagcagggaaccggatcggggggtgtcaggcggcgctggcctcggccatgcgccggcgcaggctggccgggcgcatgtcggtccagaccgcgtcgatgtgctccaggcactgctcctggctgccggcgaagccctcggcggtccagccggccggcaggtcgcggtcggcccaccagatcgagtactgctcctcgtcgttcaggacgaccaggtgcgtgttctgctcggacatctcttctccttgagtggtggtgcggtgatgggtggacggaggtcagtcggtcatcgcgacgaggacccggcgctggccggtgaacgagcgccgcccgtgcgcgaccagcaggttgtcgaagaccatgacgtcgccgacccgccagtcgacgtcgacggcgttctccaggccacggtcgcggacctggatgacgtactcgtcggggatggtggagccgtccgcgaacgtcacgtactgcggcagttcctcgggcggcaggatctgggcgagcgccttggcggtctcgtcgcccagcgcggccgggtgccactggtcggactggttgaaccagacctcggcgccggtcaccgggtgccgggtggtggccgggcgtggctgctcgacgtgcaggctcccgtcgttgcgccaggtccactcggcgccggcagcggtcaggtactcgtcgacggccgcgcggtcctcggtctcgaaggtctgctgccagctcttgccgagcccgcggccgccgtgcaggttctgggtgtaccgcacgcccccggcgaacgcctcgcgcaccccggggtcgagcgactccagccagagctgcgcgtccaccagcggggtggcaccgccggtcgccgcggcgatctggcagtagaacgcgagccgactgggccagctggtcgcgtacgacatctcgttgtgcatggagatggtgaactcggccggatactcggtcgaggtgtacaggttcgagccgaccttggtgcgcggcgagttgccgttgacgtacgcgagccggcgcggcagcagccggtcgaacacgccgtcgagctccgcgggggtcaccccgaagccccggaagaccagggccttctcctgcaccaggaggtcgtcgagggcggtgccgagcgagtcgaggtggccggcgagggcctccggggtcgccgcggtaccgatgtcttctgccgtgatgtccaacggcttccagctgtggccggccatcggtggccttcctttcctgacggggtctgctcggcgcagcatgccgagctcggctatagccgccctatacgtgttgtgcagggctttcagctcgccgcgcgggtcacgtcgagggtcagcagacgcatcagcccgggcatccggaactggctgccgccgaggtcgtcggccaccacctcctcgaccaggcgggcctgcaccaacatgtcgacgacctgctccttctccgcctcggagatgccgccgggcaggtgcagcgaggtcaccgtgaacgcgtccggcccgacgtcgcggagcatcggcaggccgcgccgtgcggcgtcgggcagcgaccggaaggcggagagcagccggccgcgcagcgactcgtcgcccagggccagctcgtcgagacggcgggccgggtcggtcagccggtgcgcgaggcgacgcaccgaccagagtggacgggcggccagccgggcgccacagatccgcagcgcggccggcagcgcgtcacagaatccgaccacggcccgggccgcgtccagatcggcgaggatccgctcctccccggcgaccgccgccagcagcacgatgccctcggccgggcgcatcggctccagcagcacggtgtcgcgccggccggcgaccgtcagggtggcccggctgatcagcagcagggtggcggccgggtggttcggggtgagcgcggccaggtcggcgccggccggcacgtcgtccaggatgaccagcaccgggcggcgggcggtggcggcccggaagagcagacccagctcgtcggcgccgcagccgggctcgaccggctcgccgagtccgtagagcagccgcttgagcaccgcggcggcgggcagcggcgcgccgttctggtcggtcagcgaggcgtacgcgatccgtccgccgaaggcgccggcgcaccggtgcgcggcccgcaccgccagcgcggtcttgccggtgccgaccgcgccggtgagcagcacctgccggggcccgttggcggccggccggtcggcggtgagcagccgctccagcccggccagctcgtcggcccggccgacgaagtactgctcgtccggcggcagcgtgaccagcaccggctcggcagcccgcaccggggccggctccggctcggccgtgtcgctgatcagcacctcctggtaggccagggtgagcgcctcgccggggccgaccccgagctggtcggccagcgtccggcgggcccggtcgtaggcgaccagcgcctccgagcgccgcccggcccggtgcagggccagcaccagctgggcccggaactgctcgcgcagcgggtagcgggcgaccagctcggtgagctccgggaccagttccaggctgccgcccagctccaactcggcctcggcgcggcgttcacaggccagcgcgtacgcctcgtccagccagggcaggtgccgctcgcccagcggctcggtgacgttggccagcgccgggccgcgccacagcgcgagggcgccgcgcaggtcgtcggcggccgccgcccggtgtccctgggcgagtcgctcggcgccacgggcggccagttcctcgaaggcgaacaggtcgacgaacgagtcgccgatgtcgagcgtgtagccggcgtgctcgcggacgatgcgcaccgcgaagtcgagccgcttgcgcagccgggagacgtaggtgtaaatctgcgcgtccaccgtcgcgggcgggtcccagccccacagcagagcactcagctcggcgtgcgggacgacctttccccgggccagcaggagtgcggcgagaacggtagtgatcttggagccgggcagcatgacgcggcggtcacgccgccacacctccaccggtcccaggacacggaattccaggtcattcacggttccacctccgcgctcggcatacaccgaggcaacgcccccgtcggcttcgagcagatccagtgcgacgacgacgtcgcgctaagaggaccctcgttcacccgcccggccgattccatagaggaccagcccgataggggtcgctcaatggtttgcccctcggccgcaggggtcgggcgcctcccgcccgggagatagccggaatatcgagccgggccgcaacctcgcccgcgtgagaactcgcgcgccgcgcctgcggctgcttctgcgtcacctgcgcccgcaccgccgcggcctgctgaccggcgccggcctgatgttcctcggcggcctggccggcctggccgcgccgctggcggtgaaacgcctgctcgactccctcgccggcggggcgccggccggtggcgcggtggccctgctggccgccctgctggcggccggcgcactgctcggcgcggtcgggatgtatctgctggaggccaccgcggagggggtggtgctgggcgcccggcgcggcctgatcgaccggctgctgcgcctgcgggccggggtgctggaccgggccgcgcccggcgacctgctggcccgggtcaccggcgacaccacccagctgcgcgccgccgccaccaccaacctggtcgacctggccaccgggatcttccaggtgaccggcgcggtggtgctgatggcccggctcgacccggtgctgctcggcgtggtggccgcggtcctggtgctggtgctcgcggtgaccgcggtgctggccgggcggatccgccaggccggggagcggacccaggcggccgtcggcgacctgggcgcgctgctggaacgggcgctcggcgcgctgcgcacgatccaggcgaacggcgccgagcgggcccaggcggcggccgcgcaccgggcggcgacccgggctagctagctagcaggtggccttcgtggtggtgctcggcgtcggcggcgcctcggtggcggccggccggctgaccgtgtcgtcgctggtcgccttcctgctctacctgttctatctggccgggccggtggcccagctggccggcgggatcgccgggttgcagggcgggctggccgcggccggccggatcgacgaggtgctccggctgcccgcggagacccccggatccgccggccgggccgggcccgccggccatcgggccgctgtcggtggccttccacggggtctcgctgcggcaccgcccggacggtccggaggtgctgcgcgacgtgaccctgcggctcccgccggccgggctgaccgccctcgtcggcccgtccggcgccggcaagagcacgctgctcgcgctggtcgagcggttccgggaaccgaccgccggccgggtcgaggcgggcggccgggacgtgcggcactggccgctgcgcgacctgcgggcccggatcggctacgtcgagcaggaagcgccggtgctggccggcacgctgcgcgacaacctgctgctgggggccccggacgcgtccgacgagcggatcgccgaggtgctcgcccagaccgcgctgaccgcgctggtccgccggctgccgcacggcctggacacggtgctcgggcaccgcgggtcgacgctgtccggcggcgaacgtcagcgcgtggccaccgcccgcgccctgctccgccggcccggcctgctgctgctcgacgagcccacctcgcacctggacgcggtgaacgagcaggcgctgcgcgacctggtcacccgggtggcccggaccaccaccgtgctgatggcggcgcaccggctgtccacggtgacccgcgccgaccgggtggtgttgctggagcagggccggatccgggccgtcggcacccacgacgagctgctcgcccgggacgggctctatcgccggctggccgcgacgcagctgctcgtatcgagtggatatagagccggacccgatgcttgaccggtccgagtcacccaccgagaggtaagcatcgcgatggcaccgaccacttaccagcgcccgacgctgaccaagggcggctcgttcgcccgcaagaccgccggcagcctcttcaccagctgccgcgaatcgttcgtgacccagaagccgaaggccgtctgcaactgacggcatgactgaccgaccggaggggcgactcatggcgctgttgccagacctggcgtcacaagtgtcatggttcgtagcggtgccggacaacgatgccggccaccggatggcagggccactcctgcggacgcccaccggcgttccgggtccccgcccgcggacgcccaccggcgtcccggggatggtcgcccacgcgtccggtcgcccctggctggtcggtcgatggcagcccggtgaggcggtgacggccgcgatcggcccgaaccgcctcgccgcgctgggtgagcaccggctcaccgccgacgacctgcggcggctcgcgcgcggcgcgcgcaccgccgaacagctctgcgagagcctgcgcgggcagcccggcagcttccacgtgatcgccgccgggccggacggcctcgccgtgcagggcagcctgtccggcttccggcgcgtgtaccaccacggcccgctggccggcgaccgcgccgacgtcctggccgccgtgatcggcgccggcgtcgacgacgaggcgctcgcggtgcggctgctgagcccgttcgcgccctggccactgttctggaatccggtctttcaccgcattgcggcggtacgcccggacgagcggctcgtggtcgctccggacggcacgccgcgcctccggcgccgctggcagccgcccgcacccaccgtcgacccgggcgaggcggccacgtggctgcgggacgccctcgccgcggcggtcgcggtccgcggcgcccccggtgacgtgctggccagtgacctcagcgggatggattccacctcgctctgcgcgctcgccgtccgggacggccggcacgtgatcgggctgacctgcgtcagccccgacccgctcgacgacgacctgccctgggccgagaccgcggcccgggagctcggcaaggtcacccacgaggtgatcgccggggacgccagcccgctgccctacaccgacctgcaccggccggccgacggcttcgacgagccgaccgccgcggtgatgtaccgggccggtttcctgggcgcctcgcgccgcgccgccgggcacggtgcccgggtacggctcaccggcttcggcggcgacgagttgctcaccgccgatccggccctgcagctcagcctgctgcgcaccgacccccgggcggcgatccgcaacctgcggctgctgcgctcggcgtaccgctggggccgcaccgcgacgctgcgcgcggcgttcgaccgtcgcccgtacggcacctggctggcctcgctgaccggtgacggtgacgcgggcgccggaccgatgctcggctggggtccgccggccgcgctggcgccctgggtcagcccggacgcgcgggccaccgtccggcggatcctgcgggagcaggccgcttcggccactcccctgctcgacgaccgtgggctgcacggccggctggccgggctgcacgccggggcggccgccgcccggcacctggcccaggcctcccgccggaccggggtcaccgtggccctgccctatctggacgacgccgtggtcgaggcggcgctgagcgtgcgcctggccggcgtcgcctcgccccggcagtacaagccgctgctcgccctggccatgcgggacgtgctgccggagccggtgcgccaccgctccaccaaggcggacacctcgatcgccgcgctccggggcgccgacgagcaccgcggcacgctgctcgacctggccgaccggtcccagctcgccgaccgcggcctgatcgacgccgcggcgctgcgggccgccctgacggcgcccggtgaccgcaccttctacgacctcgaccagaccctcgcggccgaggcctggctgcgcgtcccgggaaacggagatgcccgatgaactggaccctgccggcccacgtggcctggaccccgaccgagtacggcggggtactgctggactcggcgatcggcgagtactggacgctgaacgcgaccgccgccaccatgctcgactgcctgctggccggcccgtccccggccaccgaccggctggccgccgacctcggtgccgacccggcgacgatcgccgccgacctggccgagttcctcggtgagctgcgcggcgccggtctggtggtggcgagatgaccaccgagcaggtgctcgcgcaccggccgagccggctgggccggcggctgacggtgctcgccgtggtggccttcgcccgggtgctggcacaccggtcaccggacctgatctgccgggtgctgcgccggatcagccgcggcgcccgaccggccacccgtcaggaggccgccgcggcccgccgggacaccgtggcgaacagcgcgttctgcgccggcccggtcggctgcctgccccggtcgatcgccaccgcgctgctctgccgccagcggggcgcctggccggactgggtggccggggtgcgccggcacccgccgttcggcgcgcacgcctgggtcgaggtcgacggggtggcggtggacgagccgtacccggacgggttccacatcccgatgctcaccgtccggagcccgtcgcgatgaccaccacgctgctctacctctcctggaccggccggggtgccctggccatggtcttcgccgcgtcggtgctggccaagacgcaccgggtggcggcgttcacccgtttccggcaggccaccgccacgctgaccgggcagtccggccggcgcgccggggtgctcgccgtgctgaccgtcgccgccgagaccgcggtcgccgccgggtcggtcgtcgcgcgcaccgcgccgtgggccgcggctagctagctagccgcgatcggccgccgggccgcactgatccgcaacgggctgctgctggcgatcgccgcgatcgccctggccggcaccctcggcggcggccccgccggccggagcaccggcccggccggtccgctggtctgcgcggccgccgcggcgctgctgaccacgctggtggtccggatcggcgacgtcacggccgtgttcccggcccggcggtgagagcccgatgagtgccctgatcgccgccgtcgtcgtgctcgccctggtcgtcgcgttccacaccgcgctgatcgtggcgctgatccgccgcctgcggtaccacgccgaactgctggtcgacatcgaggagcggggtgtgccggcccgggccctgccccgcggcgcggtcctggccgcggggctcggtctgctcgccccggacaccgacaccctggtcgcgttcttctcccccacctgcgaccggtgccgccgggaccgcgccgcgttcggccgggtcgcggccggctgggatcgggcggtcgcggtggtctccgggccggacgcgtccgccggcttcctcgccggggccgtcccggccgcccgggtggtggtggacgccgacgggtcgctgcgtcacgcgttcgggatccggcacttcccggccctgttcgtggtctccccggacgggcggctggcctggaccgggatgcacgcctccgcgattccccccagttcctccgagaagaagtgagacaccatgacgagcgagagcatccgtttcctcaaccgcgccgacgtcgcggcctgtctgtccaagatggatgcggccgaggtggtcgcgcagaccctgcgggatcacacgtcgggccgcaccgagctaccccccgaagggtatctgagctggtcgaacagtgccggtgcgtacagccgggcgatcgccatgctgggagccgtgccggacggtgcggccatggcgtacggaatgaaattgatcaacgcctcggtcggcaacccgggccgcggcctggagcgggccggggggctgagcttcgccttcgacccggagaccgcgcgcccggcggtggttgccgaggccgggctgctcagcgcggtccggaccgcgacctacaccgtggtcagcctgcgggagctcgggccggaatcgttcgacacggtcagcctgatcggcaccggcacgctggcccgggtgcacctggaggcgatcgccgacgccttccccgcggtgcgccgggccgtcgtcttcgacctcgacccggcacgcgccgccgcgttccgggacgatttcgccgcccgccgcccggagctgacggtcaccgtcgcggacagcgcccgccacgcggccggcgccgccccggtgctgatcaccgtgaccaccagcaacgacccgtacatcccggcgtcctggctggccggcggctcgttcgtggcgcacgtgtccctcgacgacctgaccggggaggcgttccgcggcgccgaggcggtcttcgtcgacgacctcgaactgatccgggacaacccccgccggatcatgggccggctcctccaggagggcgtgctcaccggcggcgacggcagcctcggcgaggtgctgaccggccgccggccggcccggcggcccggttccggatacgtcatcagcaacccgttcggcatggccgtcctggacgtcgccctgatccacgccgtcgcgcaggtggcgcgggaaaccggcgccgggcagctcctcgacctgctctgacccgcacatccgaccttttccgtggagctaccgttgatcatcgaatccgcgctggatctccgatttcccgacgtcttcctcgaactctccgggttcctcccggacagccgcctctacctcaagatcgaggcgatgaacctggccggctcgatcaagttcaagccggccctcgccatgatcgacgacctggagcagcgcgggctgctccggcccggcagccgggtgatcgaatcgtcctccggcaacctcggcatcgcgctgagcatcgtctgcaacgcccgcggctaccagttcacctgcgtcaccgacaagaacaccgcgccggccaccatcgagctgatgcgggcgtacggcgcccgggtcgtggtgatcgacaaacgcgacccgaacggcgggtacctgtcgatgcgcctcgcctacctgcaggaccgcatccgggccgacccgatgctggtctggcccaaccagtacgccaacccgatcaacacgatggcccactaccacaccaccgcggccgagatactccagcagttccccgaggtcgacgcggtgttcgtgggggccggcacgaccggcacgctgaccggttgcgcgcagtacttcgcccggcaccggccacagacccgggtgttcgcggtcgacatcatcggctcgaccaccttcggcaccccgcccggccggcgacacatcccggggctgggcaccagccgcaccccggcgatcgcctccctgcagcacgtcaccgatctggtgatggtctccgagcacgagacggtgaaaacctgccggcggctgcgcgaccggcaccacgtgctggtcggcggctcgaccggcgcggtgctcaccggggtggcggaccgggccgccctgttgcgccccggctcggtggtggtggcgatcagccccgatctgggcgaccgctacgccggctcgctgtacaacccggcctgggtcgccgaacgcgaactggaccgcccgcccgcaccggtggaaccgctcgacattcccgtccccgacctcgtctgaggcgtcccgtaccggaggaaaaatgtccacatcggaggccttcaccggcctgccgccgcggcgcgagccgggcggcctgctcaccctcgccgacctcaccccggaccggctggccggcctggcgcgccgctcggtcgagctgtaccgcgaccgcaccgcgcaccacgacccgctgcagggcctgctgatcggcatcgtcttcacccgcacctccacccgcacccggaccgccttcaccgccggcgtcgaacggctcggcggccgggcgatcggctacgggccgggcgacctgcagaccaacaccggcgagtcgctggccgacaccgcccggatgttcggtctgatgctcgacgggatcgtcacccgcaccgccggcccgctcgccgacatgcggctgctctccgccgagagcggtctgccggtgatcaacgcgatggccgccgaggagcaccccacccagggcatctgcgacctggccacgatcctgctgcaccgcggatcgctggacggggcccgggtgctctacgtcggcgagggcaacaacaccgcgaccgccctcgcgcagggcctcagcgcgttcgccggcaccgagttgcacctgctcaccccggacggctacgggctgcccgaggacgccctgaaggcggccaccgcgcgggccgccggcaacggcggccacgtcaccgagtcgcacgatccgcgcgacgtgccggccggtgccgagttcgtctacaccacccgctggcagaccaccggcaccagcaagcccgacgcggcgtggcgggagaccttccggccgttccacatcgacgatcaatttctggggcgtacgccggatgccctcttcctgcacgacctgcccgcccaccgtggcgaggaggtctccggcgcggtcctcgacggcccacgctcggtcgcctggtcacaggcgcggatgaagctgtgcagcgcgatggcggtgctcgagtacgcgttcggccgggactgacgatgaccgacgatctggcgacccggatcgccggtctgctgcgccgggcgcatcccctgcggatgggctcggcgatccggcaggccgacgaacttctcacggacatcgggccggccggtcgggcagcggtcctggaacgcgcgatccatctggccctgcacggcgaatgacgcgaggcgcccggcgatcccatgatcgccgggcgcatggtcatcggccctccgccccgaagcgacgacgacccgcccgccgcacgccgggcggatcgtcgtcgccgctgctcggacgccgaggggtcgtcgatcagctcggcgcgccggccgaccgccacaggtgcgggccggtcagcttgcccgccgcgtcccggccctcggccagcagccaggagccgccacccggaatagccgccagatcctcgacgtcggtggtggtcggatacggtcccgcgatgctctgccaggccgacccgccccaccggtacagcgccccgccggggatcctgtcgctgctccagcgcggccgcagaccggcataccagtcggcgccgaacttcaccacctcggcgctccagacaccgccgtcgacggtggtcccgcagatgtccggcgcgcgggtgaaaccggatccggtcgcgtgcagcgtgatgccgcacgaggacgcgcccttggggaacctgctgccggtgatccacaggtcgtccgacgtcccggtcacctgattgccccggccgtcaccgtccggcatcgccacgaccgaccaggagacgccgttgaaccgggcggcgctcatccggaacgtgtcgctggccgggtagccggtgccggccgtccagatctcggtgtcgctgatcttgtggatggtgccggcgccgccccggttgaccccggccggcaaccgggtgatcttccaggagacgccgtcccagtgcgcgacggcggcgttgatgtccccaccggcccgatcgtcaccggcgatccacacgtcgtccgggccctcgacctccgcggcggccggctggaacttcatgcccggcgtcgagtgcgcggtccaggtcgagccgttccagtggtaggcggcgaaggtgaagtccgtcccggtcggcgcgaaggtccactggtcgtcgagcgaggcggcggcgtagatcggccggccgttcgccttgatcgccggagtcgccagttcggaccacacggagccggtccactggaaggtctggaacttggaggtgcactcgaagcagatggtgggctgcgtcaaggcgtagatcaacgcggcgtccgggccgaacgcccggatctccgcggagacgatcttgcggtcggtgccgaccggcaccgggacggccgtccaggcggccgccgcggtggccggcgcctggacggcgagcgagagaccggcggcgaccagcgcgccggcggccacgagggcggttgtacgacgaatcaagacggtggctcctccacgcgaggtgactgggcgcccagtcttcgacggacgtctattgccgccttatatcgcatccggcccgtgcccctaccgaccggtaaaaggtgccgcgccggttccccggtccggggcgcctccgtacgctcgggtcatgtccattgtcgagagggtgcccgccttctcaccgccgcggaggccgcgatgatcgagtccatcctgcccagcgccgtcaccgcggtcgacacgttccaggacccgccggaggccggcctcttccccgaggaggagttgctggtcagcacggcggtggcgaaacgtcgggcggagttcgccaccggtcgctggtgcgcccggcaggcgatgctgcggctcggtcaccggccggccgcgatcctgcccggcccgcgcggcgagccccagtggcccaccggcctggtcggcagcatcacccactgcgccggctaccgcgccgccgtggtcgcgccggccccgcaggtcaccaccgtgggcatcgacgccgaaccgcacgaggcgatgccggccggcgtcctggaggcggtctcccaggcggccgaacgcgaccacctggccgccctgacccggtaccagccgggcgtgcactgggaccggctgctgttcagcgccaaggagtcggtgtacaaggcgtggtatccactgaccgcccgctggctcgacttcgacgacgccaccgtcaccttcgacccggcggcgggcaccttcaatgcccgcctctcggtgaccggcgcgcgcctgcacgggcgcgaactgaccggcttcagcggccgctgggtggtcggcaacggcatcctggtcaccgccatcgccgtcctcgccccggttcccgccctgctctgaccccagtaggcgccctcagccatcggccgcgccaccgctgccaccgcgccaccgcgccaccgcgccaccgggccaccgggccaccgggccaccgggccaccgggatcaccctccaccactggcgctgcccaccgtgccgccatcagtcctcgcacgctgcctccttcctcttcgccacttcgtggctttcctgcctcgttccacgccggcacgcaccgccttcggcatctcgattcctcgttgaagtgaagaagggcccggccgcatggccggacccttcttcacttgggggagggagctttgaggatgttcgggagggcgtaggccagcctgcgggtccgaggccggcggggtggccggcgggcctccgggtggaaggccgaggccgcggccggcggcgtggccggcaggcctccgggtggaactcctaggccgcgaccggcggcgtggccggcaggccttcgggtggagggctgcggccggcggcgtgggggtcgggccgccgccggccgcagcccggtcagttggcggtggcgtggtcgcggaggaggtgggccggaaggtcggtgcgccggtgcacgtccagcttgcggtagacgcgggtcaggtgctgctccaccgtgctgaccgtgatgtacagcttggtggcgatctcccggttggtgtagccgtcggccgccaggatcgcgactcgacgttcggcgtcgctgagggtgactgccccggcggccaggttcagggccgtcgccgtctcggcctcgtcgccgcccagctcggggctgagcgtggcgagcagcggctcggcctcggtcttgtcggccagggcccgggcccgccgggcgatcatgccggcccgccgggactcgccgaccgcctcgtacgccccggtgaggtcgaccagagcgcgggcctgctcgtactcgtcgccggcctgcaggtcgacggactggcgcaggaacatcgggcggtgccggggctggctggtcgccgcgtacagccgcattgccatgccctggaccctcgggttgttcttggcgcaacggttcagctggtcctcgatcagctcgtgggcccggtcgggcagaccggccagcagcagcgcctcggccatgtcgacccgccacggcaccaggccgggcacgtcgaggtgccatttgccggccagttccccgcacagttcgaagtcgcgcagggccagctggagctgcccgatcgccatgctgtaccggccgcgggcctgcaggtagtgcagtccgtagcgggtgtggaacatctcctccggcaccggctggtcgagctgttcacggaccaggtcgtagcggcccatcgcggtggccgccagcatcatcggcgcgaccgcggcgccgatcgccaccccccagctggccggcggcatggtgtcgagggcgaacctggcgtgccggacggcggcgggcaggtcgccgaggcgcagcgatacttcggcgcggatcgcggacagccgggccagccggctcggcgcgcggcgggtgaccgcctcctcgacgaacaggtcgcaccaggacgccgcctggtcgcaccagccaccgtaggtgagggtgagcagcgcgctctccaccgtgtccaggctcatctcgtccagccgggagttgtgcaggatccgctgcaccgcggtggcgatcttctcggacgggccgcgggtgagcaccgtggccagcgcggtcgccgcttccagccggtggctggcggcgaccgtcgacacggccggcggccgctcggacggctggcgcagcagcgcgaagaacggcgggtaggtgcagcgcagcaggggccgggcgatcgccagttcggtcatgccctcctggtcgaggtcgtcggtgaccgcgttcaggtggtcgaagaccgtgcgtgccgagctgaactggccgtcccagagcagcgctttggtgagcgccagggcgtcgccgccgagcaggaatccgcgctgcagggcggcggtcagctcgggcaggtacgcggtggaggtgcccgggttgatccgccaggcggcccgcagcatggtcgtcatgatcttcgcccggtgcggtccgtcggcgcaggtctgccaggccagccggaggtagccgatggcggtgtccacccggccctcccgcagcccctgccgggccgcctcctccagcaccgggacggcccacgggtcgtccgcgcgaccggcgccgagcagctggtcggcgaccacccgggtggcggcgccaccgtagtgggcgagcaccgcggcccgccggtgcatctcgcggcgttccgtgtcggggatctcggcgagcaccgcttcccgggcgaccgggtgccggtattcgccgttgtgcagcaccccggcggtggtcagggcgcgcagcgcctggccgatgtgcgccgcgtcgacgccgagcagctggtccaggagtccggtttcgggcaggatcgcggcgccccgggccacttcggccagctgtgggtcgatccggtgcaggcaggacacgacggcccgggcgtagtggccggcggtgaccggttcgccgtccgcggcgccgccctcggcgagcacctgccggtggtcggcgaccaggccggtgaccagcagcgggttgccgccggtgagctggtgccagcgcggcgcgatccggtcggcctgctccgggtcgagcacctcggcggccatccggcgcacgccttcggggctgagcgcggcgaccgacaggtgcgcgccctgcggcggccggctcagcgcctcgagttcgaccgcgggttcgtccggccgggcgtacgaggagaggctgaacaccgcgagcatcggcgcgaaccgcacccggcgggccaggtaggagaggcagagcagggatgccgggtcggcctggtcgatgtcgtcgaccacgaccaccagcgggtagcgctgcgacaggtccagcaggatggtgcagagcgcgtgcacgatctgcgggtccagccgggcggcgccgtccgggccggccgggatgctctgggcgccctcgtgcagcaggtccatcgcccgccggctgtcctcggcgaccagcggcgcgtccatcagcagctggccgaagacgccgagcgggaggtcccgttcgctgcgcgcgccgaccgcggtgatggccaggccgttcaggtcgaccacccgttcggcgaaggtgttcagcagttcggtcttaccggtggccacggaacccgtgaccatggcgacccgtccctttccggcgacggcggctgccagaaggctgtccagcaccgccatcacgccgtcccgttccaccagttccatgacttcttcctcgttttccgcgagcgcttccggcttcgacaccctgtacgctacgggcctgccttgtcggtccgttatctctcgcctatcgcggttgacctgcgcttattcagctggcgcgggccatcggatagggagtttcgtcgattcgataggcgccccgcggccgctcggcgggccggcccaggcgggccgcggcggagcggacggcggccaggatcgccgactccacgtcgtcgtcggcggcgacgccccagagcgtccgttccccggcgcgcagctcggcgtagacgccggtcgcggtgccgtcggccagcccggtgccggtgcggtgcaccgcgcgcaggtcgatccgccaggcggcgaggctctgcttgacccgctcgaccgcgtccgcccgcaccgcgccgacctcgaacgcgtgaccgtcgacgtgcagggtgaccggcaccgcctcgcgcagcggcagtggcacggacagcagcggccgggacacgtactcccgggtgaagagctcgacgatccggtcgctgtcgatcgggccgccctccgcgtcggcccgggcctgcaccagtgcggcgaactcgcgctgcaggtcgcggggcagatgcagacccaggcaggagctgatgacgtacgcgacgccacccttgccggactgactgttgatccgcaccacgctctcgtaggtgcgcccgacgtcgtccgggtcgatcggcaggtacgggatctcccagcgctggtcgccggtccgtttccgctcgtcgaagcccttcttgatggcgtcctgatgggagccggagaaggcggtgtagacgaggtcgccggcgtacgggtggcgcgggtgcaccggaatctcggtgcagtactcgacgacccggcggacctcgttgatgtcggagaagtcgatgcccgggtcgacgccctggctgaacatgttgagcccgagggtaaccaggtcgacgttgccggcccgctcaccgttgccgagcaggcagccttcgatccgctgcgcgccggcgagcagcgccatctcggcggtcgccaccccggtgccccggtcgttgtgcgggtgcacggagaggcagacgtggtcgcgccggctcaggttccggtccagccactcgatctggtcggcgaagacgttcggggtcgcccgttccacagtggtcgggaagttcaggatgatcgggcggtccgccgccggctgccacacgtccatcaccgcttcgcagacctccagcgagaagtccagctcggtgtcgttgaacagttccggggagtactggaagccgaggtcgcagccggcgagggtgcggtcggcgtacttgagcatcagccgggtgctctgcaccgcgagctccttgcactcggcccggtccatgccgaagaccacccggcgaaactgcggcgaggtggcgttgtagatgtggatggtggcccgcggcgcgccggccaggctgtccacggtgcgccggatcagctcgtcgcgggcctgcaccagcaccgagatccggacgtcgtccgggatcaggtcctcctcgatgagcaggcgcaggaaatcgtggtcgtcccggctggcgaccgggaatccgacctcgatctccttgtagcccatcgcggtgagcagccggaacatcgtgagtttgcggtccgggcccatcgggttgaccagcgactggttgccgtcgcgcaggtcggtggagagccagcgtggcgccgaggtgatggtccgtccgggccaggtgcgttccgggaacgtcggcgtgaacggccggacgtacttgttccccattgattccccctgatttctaggacgggaccggatcagtcccggaagccgaaatacatcgagtaggagtagggcgcgagccgtacctggacctgacagctgtcggattccccggtcaatcgcacgacgaccgagacctccttgtacgcggtgctcaggccgagcgtcgcgaagtaggcgttgctgtcgaagacgagttggtacgggccgcggccgagacgcttctcggtccaggcgcgcacgtatccctcgtggtcggtctcggcgtgatccacggtcacccagtcgtccagttcgtgccccaggtcggagatcttccgctggagccggacctgcacacccgcggccggccggccgtacacgacgtccactgcttgcgcggagatactcatgaaactctcaccctgccgtccggttccgcggcgccatcgcccattggcgacatactccgttatcgcgttatcgccgcacgatcctttcgttatcgtcgacggccatcgccggaaagccggtcaatggatcgcttgataacacggcgataggggaggcccctagcgtcaatggcgtcgacacggtgagcaccgggtcgaaactcctcgaaattgaaaggcgtacattcccatgcgtaagttcacccgccgcagcgcccgtttcgtcgtcgccgccgtcgccgccgccgtgctcgccgtcctcggcgccgccactgccgacagcaacgacacgacgcctgcgcagcccggcacgccggccggcaccagcgtggccaccggcgccgacgacaccacgatcagcggcacctggccctgggaagggtgaattgcccgccacgcgaaaagggaaggcatccgaccggataccttccctttctctctgctctgttgtcaggccacgcgacactgatttttcgttcgttgcagcatcgccagaacacgttcctcgaaaagcggggcatggatctcccggaacatcaccagcgcccgttccaggtgggtggtcgccgcgtccggcaggtcggcggccagcgacagctcgcccatgcagaactcgacccgcgcctcgatcaacctctcgccgttgatggacgcgagttcccgggcccgggccagcgcggcgccggcctcggtgaggtcgccggcgctcagatacgccgcacccagtccgagcgtcgcgtacgcctcgccgatcggatcacccagcccgtgtgccgcggtcagtgcctcgccgaacacggtcaccgccgactccggctcgccggcctgaaggtgggcctggcccagccggtgcagcacctgcgcctcgatgcgccggccgccgacccggcggctgagttccagcgactgctccagcatcgccttggcgtcgccggcgttgccgcgctccatctcgatctgcgccatgctgtgcagcacataggccagcgcggccggattgccgccgcggcgaaccacgggcagcacctgctcgtaccggcgggccgcctcgtccaggttgccgtccatccgctccaggtaggccaggtgccggttgaccatggcgtggccgctctcctcgccgagcacctcgaacatctccagagcgtcttccagccgacgacgcccttcggcgaaccgccgctccgcgatggtgagtgcacccatcgagtagaggaccatgccgtggcccagccggtcaccggcccggcgcaccgcggcgagtgcgatctcgtgagtggtccgccagtcgttgaggtagacccgcgtctcgaacagggtgaccgcggtgaccgccagatcccagcagtactcgaccgctccgacctcggcggcctgacgcaccgcggccacgatggactgccgctcccgctcgaaccagccgagcggatcgctcagcatccggtccaccgaccgctgtgggatccgccagcgcggcgccgcgctgtgcacctccttgttgccctcgccgtagaacttccggtgcgcctcctcggacaggaacagcagaccgccgaacacccgttgcagcgcggcgttgcgatcggccagcggttcctcggcggccagccgctcccgggcgaagacccggatcaggtcgtggaaccggtactgccggtgcgggccgggctcggtgctgtcgatctccaccagctgggcgtcgaccaggtcgtccagcaggtcgtaggcgtccggcagcgcctcgtcgagcagcgccgcgcagacccaggccgagaaggccgggctgtccacgacggcgagcaggcggaacagtcgccgggcggcgtcgctgatgttgtcgtaggtcagcgagatgctgacccgcacccccatcgcgccgtggttgagctcgtcgagccggcgcgactcgttctccagccggtcggcgagctgctcgaccgaccagtgcgggcgcgccgacagccgggcgccggcgatccgcagcgcgagcggcagccgcccgcacagctcggtgagggcggcgaccgcgtcggtctcggccaggacccggtcgtccccggcgatccgggacaacagcgcgacgcagtgcgacgggtcgagcacgtcgatgtcgacgtgcaccgcgccgggcagggcgccgagccggctgcgggtggtgatcagcaccgcggtgcgcggattgcccggcagcagtggcagcacctgcgcctccgagccggcgttgtccagcaccaccagcatccgccggtcggagagcagcccccgatacatctcggcgcgctcctccagcccgtccgggatggacgcgccgggcaccccgagggtgcgcaggaaccgctccaggatctgcatcgggctgacccggtccgacgaccgcccgtgcaggtcggcgaagagctgcccgtccggatagcgcggtgccagccggtgcgagacgtggatgccgagcgcggtcttgccgatccccggcttgccggccaccacgatgatcggcacggccagctgcgccggatctccggcggccgccgtcaggtgcgcctggatggcctcgatctgctcggtgcgtccggtgaagtcggcgatgtcggtgggcagcatgctcggcaccggctggcccccgcgagccgccggggccgggtcggcgaccgcccgcgccgcttccggttccagcacgagcagatccggcggcggcacctccggctccaccaccggcaggagcgagagcgggaccgcggcggtcgtcgcctcgggcgcgctcaggtcggcgtcggaggccaggatcgagcgttccagctgctgcagccactcgctgggctccaggcccagctcgtcgatcagcgtgcgccgggccgcccggtaggcgtccagcgcctcggcctgccggccggagcggtagagcgccagcatcagctgcccgcgcagccgttcccgcagcgggtaggtgccgaccaggccgaccagctcggcgatcacctcgcggtggcggcccagctccaggtcgtactcgatgcagtcctcggtgacggtgagccggcgttcggcgagccggtcggcgaccatccgcagcggctcgctgtcgagcccctccagggccggtccgcgccagagggcgagcgcctcgcggtagcgagcggtcgactcctccttgcgtccggcgttgcccgccgcccgcgcctgcatgaccaggctctcgtatcgttggagatccacgtcgatctcggtgggcgccagcacgtaaccctggttgcgggtgacgatcgccttgggatggccgtgctggccgaaaagcctccgcagcgcggagacgcagatctgtacttgaacgcgggcgctggacgggaggctctcgccgtagaccgctcgcatcaggcggtcgatcgagatcaccgagccggcttcgagcaccaggctggccaggacgatctgttgacgattaccgccgacatcgatgcgctgaccgtcgatgagcgcgtccagcggtcccaatacccggaattccacggtcacgtggcatctaccgccgggtgtgccgaaaacagcgcggctgtactccgctttctcgccgccgcctatcgatttccggtctgtccctcgggccgatgtcaggccgccggtgacgttgtgttcgcaagcgtctgtcccccatgtgtcgccccgagcgtacgaactctcctatgtggttgccaccacccgacgcgaagggggaccaaccacccagaaaatattgtccgatctatcgattgcctcggactcctcggtcatgcagcagccgtcttccgcactccattttgccctaactcggaacttaggccaaaaatgcccggtcacgcttggtgaggtaacgcttaaggaaagccttatccaccgggcgggtccggaaccacggcgggatgccacggccgtgccacgatgctccggcccggcacaccgccgggacgaaacgacgaagcttatcgacgtacgccgcaatcggcgaagccggacggcgcgcaagccggccgggagggtgaccgcagccgcggaccgcgaccaccgccccggcccgatcgcgggtcaggacgtgcggaccgcccggtacgcgcggatcgccggggccaggccggtgagcaggccgatcgccagggtgatcgcgatggtctgtgcgtagatcgcgatcggcacgccgagatgatcgaggcggacctgggagatctggttgaaccggttcggatcgagccggctggcggccgccccggcgagtaccgcgagcacgccgaccaccgccgcggtcagcagattctccagcagcgccagcaccccgacggccgggcgggacgcgccgagcgcccgcagcgtggcgaactgcggcgcccgcacctcgacgaacgcggtggagacgatgccgaccgcgagcgcgcccaggaccagcacgatcaccgagaaccgctgcccctcctcacgctgctgatccaacaccgggcggaactggtcgatgtcgtcgatccggctctcgaccgcggtgacgtgaccgcccaccgcggtgcgcaccagggccgccgcgtcgccgcaccggatccgcacgcaccgccagtagacctgcacggtctgcgggccgaggtgcgccagatcgatcacgttctgggtgacgaaaccgtcggcggccagcgacttgttcagctcggtgtaggtgccgaagaccggcacaccgccgagcgcgatccggggacgcaccgaagcgcccgccgcgacctgggccggggcgtcgccggccgcctgctgccgggcctgctccggcccgggtgacgcgccggctcccggatggtcggcgaccggggcgtccagcagcagggtcaccgccatcggggcggccacgccgagccggcccgcggtgtcccggtcgaggagaacggccgggccgagccggcgatcgtcgatgaccgtgcgccacaggtcgtcgtcggccagcgccggggtcagcaactgccagtcccgggtcaccgaccgcagggtgaccggcaccagtgcgctcgggtcggaggtggccgacgcccgcacgtaggcggtcacgttcaccgcggtggccgggcgcagccaggggtggctgcgggtgatgtcggccagccggtcgttgagggtgtgcagggcggcgccggtgcgctcgtccgggatggtcaggctgtacgtctccgcatagccgaagaccgcggtcgcgtaggactccaccgcggtccggctggcggtggccgcgatcgcggtgaacagctgcacgctgatcgacacgaacaggatcgcgccgaagatcgcgttgcgccgccagttcgaccggaactcgcggacggcgagcagcggaacctgcatcagggcgcctccaccacgtccgcggcaccgggctcgtgcaccgcaccgccggcgatcagcacccgccggtcgcaccgctcggcgaccgcgtcatcgtgggtgaccaccaccagcgcggcgttcagatcccggaccgcgtcgagcagcagggtcatcaccgcgtcggcggtctccgcgtccagcgcgccggtcggctcgtcggccagcaccagggccggctgcttgaccagcgcacgggcgatcccgacccgctgctgctcgccgccggagagctgggcgggacgggactgcagccgggcgccgagcccgacccggtccagcgcctcgcgcgccgccgcccggcggcgccggccgcgcagaccggccaggatgccggcgtactcgacgttctgcgtcgcggtcagattgggcagcaggcggaaatcctggaacacgaagccgatcgaccgggcccgcagccgggaacagcgacggtcaccggcccggcgcacatcggtgcccagcacccggtgctccccggtgtcgaacgggatgaacaggccgagggcgcgcagcagtgtcgtcttgccggaaccggaccggccacggatcgcgaccgcctcacccgccatgatcgtcaggtggacgtcgcgcaggacctggagccggtcgccggtgggcagctgcagcgtcttccccgcgccgcgcgcctcgacgaccggtcggctatcggtcaaagttcgaatccagcgggtagacgagcacgtcggcgtccggatccagaccgctcacctgcacataggcgtcgtccgccgcaccgatgacgacgtcgaccgtccgggtgtgcccggcctggtccagcaccaccacctcgccctgctcggcgcgcccacgcaccgccgacaggggcagcgtgtccacgtccttcagcgcgttggtgacgaagacgaccaccgcgtgcagcccggcgaagaggtccacatgcgacggcgcggagacgaacacgttgaccgtaccgctgctctggtcgaaggtccgccgctcgaaccggacggtcagcccggacgggccgccgacgatctgcgccttgcccgacgacggcgggtgggcgaaattgaacagcaccgacttgtcctcgaccggcagccggatgtggaatccgggcggacggatgttggcgatcaccgcaccgggggcgacgttctgctcgccgacgtcggacagctggcccgcggccggggcccgcaccgcggtgtaccgataggcgcagtgggtggccgcggtgccacccgcggacgcggaggccgacggcgccggattcacggtgccggcgttctgctcgtcgggacattgacgcaccgcaccgagccggaaaccccgcggcaccgtacgcccgttccggaccccggcggccggaatgaaccggccgtccaccgccgccttgaccggaaccgcgtcatacggctcgaccaggccctccagacgcaccgtctgatagatctcccgtttctccacccggaccgtcgccggtgcggcggtggccgacgcgaccaccaggtcacccgcccccgccccgctaccggggccggcgtcgccggtggtggtgcaggccgcgagcagcacggtggcacccgcgaacacggccgcacgcgccaccacccgactccggagcatctatgcgaagcccttctggcagtcgttcgcgtcgatgaactggcgggcggtggagatctcgccgagcttcgcgtccgacacgatcttgtcgatcaaccccttcagatcgctgttcccgaggccgctgagcgcggactcgtcggcactgaccggcttgttggccttcgtgtcgtcgaccagctgcatggtccacgcgcaggcgttccagatggtcaccatgttggtggcgtcggaagcctgatactgggtgtcggccgcgccggcggccatgaaaccccacagcttgtcggtggtcatcttccgcttcggcggccagctgaccttcgcgtacgcctgctgcagggtgggcatgaagtcgtccttcttggtgccggtcgccgcgccggccggcttcttcgccgcgtcggccgggttgttgaccccgggcttgccaccctggcccggagccgacccggactggtcggtggacttgtcaccggagccggacgagcagccggcggcgagcaggccgagaagaagcacggaagccagcaaccgtgaacgggacgccatgaatcgttcctccaatgtggcacacgagagatgatcggggagccggaggccccatcgccggacaacgatgcgacggagcctccgaacctatacgacgtcgccaaggatcaggcgaagttgtagtcccagtaggtgacgccccggaaggcgcccgtgctggtgaagccacggaactgcaggtgcaggcaggtggtggccttgaagtcggtgccgagcacacggtacccgtcggtaccgatgttgtagttgatgcttccgtgcacgctcgaatccgagcacttgacccagcgcatgtcgatcgccgggccggaggtgacatcgaaggcgatgtcgtcgccggcgtggtcctgggtgtaggtggtgctgccggtcgtgaagttcgtgatgctggtcgtcgtcccaccggtgttgtaggacgaggcgagagccggagccgcggtgattcccagcagggtcgcgatggccacgacagccaccacggccagtccggcagtgcgtttgatcatgaatcctctccccgttagcaggaactgccgcatcgcttgcggcagggccaaccgatcgatcgatcggaacggactctaggcagagggttctatcgatgtccgcccggtactcgtgaatacgctgcgatcggcgccgaaaacgcgatccggttcggacacggagctgacaggaatccgattcattcacgtgtatcaaaaggttggggcgccattcccgggcggccggtccggtcaaacgcgatccggcgcccagcgtcccaccatgtgggcgacctggtcgcgcgacacgttgtcgcggcgctactctgacggaggttccatccggcggctgaacggatcgacatgtcgtggatcaacgggcttggcgtaaagaaatccttggccgaggtcgcaccccaggtcccggagccgggcgtgctgcgtctcggcctcgatgccctcggcgatgacggtgagaccgaggctgtgacacagccggacggtgtgcttcacgatcgccgccgcggccgcgtcgccggggtccgccagatcggcgacgagctcggccgccagcttcaccgtcgtcaccggcagccgcgccagcgaccgcaggctcgcataaccggtgccgtaatcgtcgagcgccagccggacaccgagggccgccaggtcgtcgagctgccgcccgcaccggtcgacgaccgcgctctcggtgatctccagctgcaggcacccggccggcatcctcgtccgatagagcacatccgcgaccccggcgacgaggcccgggtcggcgagctgcgcgggagccagattcgcgttgatcgtcaggtggcggccctccgcgcgccaggccgcgccctgccggcacgcctgctccaggatcgactggcccagccgccggatcaggccggtctgctcggccagcgtgatgaaggcggccgggctcagcaggccctcccggggatgccgccaccgggccagcgcctccaccccgacgacgctccggtcggccaaccgcaggatcggctggaaatgcggctcgaactcaccgcggtccagggcgaccggcatcgccgcggccagccggttccgccgggaatcctgtcgcgcccggcccggctcgaagaccatcaccccgcccgcgtcatccccccgcgcccacgccaacgcccggcgcgcgtcgcgcagccactcctccgggtccggccgcgcggcgatcggcgcctccacgatcccggcactggccgtcatccggggcgcatagccgtccaccgacggcagcaccacggtgcgcagcgccagcccggcaagcttggcgaccttcaccatctggtgcgcgcccgtcgtcccgatcaccagcagcgcgaattcctcaccaccgaggtgcgccagcagatagcgatcgtccgcctccggccgggcggcctggtcccgggcggtggccgaccacgagcggacgagatcccggagccgccagctgatcgccgccagcagatcgtcgccgtgggcatggccgagggcatcgctgagatcggcgaagtcgtcgacccgcaacaggcacaccccgatccggccggacccgtcggcggtgacgcgccgcagcacgtcccggaggtgggcccggttcggcagcccggtgaccggatcgtgcagccgggcgtgctgccaccggtgatgcagcacggaccggtcggcctcccaggtcacccgcatcgaccggttgatgtcctcggcgatcgccatcgcggtgtcccgcagcgccgcggcgaacccgttgttcacctgctcgaggaccaggtccacccgtacgccgagcgccgcgacgtccccggcgagaagctccgtcagctcggttctgagcagcctgatcgtcgcgccgatcaccttcgggccggccatccgcagctcgaccagccgggcgccgatccgccagccggccgccgggtcgaacggctcaccggcgaccgtcgactcgaggcgccggagcaaccgctgaagctcccggagcaccctcgcccgtcggccgggcacgaaaccggccgcggcgatcgcgctcaaccaccgctgggccaccgcattccgggctgattcgtcgaccatgacgaaggtcctctcccacagccgagggccggccacgctatgtgaccaaccgacgaacactgtgcagggtggacgcccaccgcaccactcttgaaggagccctacccgcggggtataaccacaagatccgtcgaggatccgcgcaggtcacggccgtggcggcaaaagcgcgcggatcgaccggcccccgttccactcccccgggtgactacctccggcgggccaccacgaccagcgcggtcggctgcggcgggatctgggcggcctgctccgggtccggccgccactggtcggcggcgaccacaccgggctccagcacctcgaacgactcgtccagcaggcccagcaattgctcacggtcgcggatcaccagtggggtcggggtcttctcgtacagcttgcgggcgatctcctgccgccgcaggccgtcctcggtcacctccggcccggcgtgcgacaggaccaggaaactgcccggcatcagcgccgccccgatccgggagatcagcgaccgcggatccgcctcgtccgggacgaaatgcagcaccgccaccatgaggaccgcaatcggccgggagaagtcgaggaacgagatcacctggtcgtgccagacgatcgtgtcgggatcgcacaggtcgccgcggatcgcgtgggcgttcgggttgtcgcgcagcaggctgcggctctgctcgaccgcgatcggatcgatgtcgacatacaccacccgggcgtccgggtccgcctcctgcgccacctcgtgcacgttgcccagcgtcggaatcccggagccgatgtccaggaactgggtgaccccgcgctcctcgaccagccaccggaccgcccggccgagataggcccgattggcctgggccaccaggtgcgcctccggaaacgaatcctggacgtgatgccagaactcccgatcgaccgcgaagttgtgcatgccgcccagcgcgtagtcgtacacccgggacgcgttcggcacggtgatgtccgcgccctccggcacccacgtgttcggctccaccgccacccccgccgctcggtcgtttccacatcctatgtatctccggggggttgaggggaagggctcgcatcgatcaatgtcaccccaatgagggactctcgcttttctcgatcgaccgggcgcgatcgggggtgtccgcccacccgcggggcatcccaccggcctcggcctcggtcggccccaacaccgcacctggaggcctggcatcgctgaaccaccctggtcaccgctgaaccaccctggtcatcgctgaaccaccctggtcatcgctgccaacgcctccctcgccacgcgaccatcccgaccacgaacagcgcagacgacctgatcgcgatcactgccaatgagctacgccgcctgttccacgcatgatcatcgacgcggctcgtgttccatcaacatcatcgccaatgggcgacggctctcttcatccaagatggcgaaaacgatgaaccgaccgctgtcaaccgacccaatgtagacattcgaggtggcattttgcaggaccgcgacgaaatcagcgtgaccggacagggtcttgccggcctcccgagctatctcgcctcgcacctgatatgcgtcggcgacctccgacgggacgactcgggtcacttcaaggggatggccctcgagcccgtcaagaattccgatcctctcgtcgagcttgagtgtggtgagattcttgaacgcttcgatgaggggagcggtcagcaagatacgatccatatcgctcatcttttcgatgtagtactgcacaccttggacgggcccttcgacgaggagttcgcgttcctcgaacttatccggtccgcggacacaacgcctctgagccgcgagccgcctgaacgaaaggcacccgagcttcgtcagtggcggcgatgcttgagtgtcggcctgccaggtccggaacagttcgggcatcgccgcgacctggtcggcttcgagcccgtaggcgatgaagtcccgatcgtcgaagcggttgatcgcgccgagcatctgcgcgaagaactgccggtcgaatccggggtcgacgccagaatgcacaactacttcgccgaatttcggccacgagttacaccggcatcggtgccggtgaagccccgaatgggaccagacggaccggggcgccctcccccttaccccctccagaccgcaacgccgatcaagagtcggttcggtgattcagtgccgcggcctgaacatgcctccggtgacctggctcggggtggcatcggccagcgcgggtacggccaccccgaatggcccggacacattcgaagaaagcgccttcagtcgctcggcggcgagaccgcgatagaggtcccgaagcgattgcacgacgtcttcctcggctgtgtaggtgtcgttgtccagcgcgctctgcgcgctcatgatgttggcggcgacctcggtggcggtgtccgcggccaggtcgagcttggtcgcctccttgccgttcggcaccaggccaccaccgatggtgccggcgacatcgatgaccacggcggtcacgaacacgccggcgccagcggtcaacgcgccaccgatggtgctgagcgcacacatcgcgatggtgccccacttcatcgcatcggcgccggtacaggcgctgttgctcagctgctgggttgctttgatggcgttgtccagcatgttcagcaccgacttgcggaagcggatgtggatgatcttcgcgccctcgatggcgttgcgcgagtagcggatcagctcgcgctgattcgggacgactgcttccagcggcgtcaggaaccggtcgatgaagttgctctggaaggcaccttcccagcccgccatctcgacgcgtacgtcgttgatccgcccgagtgcggccgacgctcccgtccaggcgccgtcgttgttcgcccggccctccagcattccctcgatctggcaagggactcgatgatcgggttgagcgcgtccgggtcaggttgcaggaaacgctcgaacgacggcaccacccactcgtagtcctgggtacgcacccggtcacggtagcgatcggcttcctcgggcgagatcggggtagcgtcccactcccccggatgatcattggcccacttgtcgttgaccgccttcatccaggacgtggcgtcctcgagcgtctggcggatcagctccttcttgagcttgagcgccttctctcgtacggcgttttcgtacgcctgcccagcgagctcggcaggcgtcgccagttcggtgtccgccatcatgtctccttcgtgccgtttgccggctcagatcacgcagccgggtacggcttgccggggtcctcgtccgaaccgggcacgggagggttggaggccgcgtccgccctgtcgacgttgtcggggtcgttcaggtagtcccgcaacaggttcgcgttttcgttgtcgacgtcgatgtaggcctgcgtcgcgttgcgtacaccctgcgcggcatccagcacagtggtgcccacctgttccatcatcagctgcatctccgaccgcaggtcctcccatgcggcgccgattccgctgatcatgacgctggagccgggatacgcagggccattgacccggaacgaatcaccgccgcccgtcgatccgccgagcaggcggttcgcgtcgtagaaaacgtccgcgatccgcggcaggtgcacctccgacacgcgccacaggtggaacaggtcaccgccggtcacttcgccagccatgtcgccactctccccgttcgatagaacagacttcaggctcgcctgcggcgagagaccaggaaaaacactgctccgagcacgagtaccgcggcaccgccgagcgcccacggccagaccggcttcggatcgccgtcagcgctgtcaccagcggacacggtgaccggcatcgagaagatccggctgcccaccgtgtcaacgacatagagcgggccggctgaagcagttcctgcggccagtccgatgggatcccgcgtaccgaaagggtctgccggaagcccggcaacagtggccgcgctggcgtcggtgccgaggcggcgtacggttcgctgctggttgtcgacgaggtaaacgccgtccgtgccggcgctaaccgtggacgcgttgaacggcgacaacgccgcccggttctcgtcagcccgccagccaccgccggcggtgtcgatgatcgtcgccagcttcccatcgtgcagccgactcagcaccgagctcgcgctggttatccagaggtctcccgccgcgtcggcggcgagaccggtcggcaggttgaccggcgtcgacagcggccggctgccagcaccgggcgcgatctcgacgacgcgattgttctcccgatccgcaaggtacagggtgccgctgggcgcaactgcgatcgcgttgatcgtggcgatcgacccaccgagcacgtccgcgtcgacccggaccgtgatggacccgtcagctgccaaggcatacacccgggaagccgcgctgtcggcgatgaagacggtgccgtcggagccggccgcgacggcgttcggtgagctgagggcgatacctgtgcccttcgtaccagccggcaccgaagctggcacggtctgccggccgtttccggcgaccgtccggatgatgccgtccttgccgacaacccgaacccgacggttgagggtgtcggctatgtacacactgccgtcggccgccacggcggcccccaacggccgattcagcttcgcctcggcagccggccccccatcaccgctgaacccgggcgcccccgcgcccgctacgagggtcggcgtggctccgtcgggttgcgccaaggccggcgcgggcatcgcagccgccgacatggccagaaccgcgagggcggcgacagatttcctcgtcacgtcggaggtgtaccacagcggcatactgtaggttcacctgcgccgatcgggacgtgatgctcaaactacggaaacggtggcagcagtgtggtacggcgacgttgatctgggcgagcagttacgcacgatgacggtgaccgccacctcgccggacggcgccatccgggccacggtcaccggcgagaaccggctggagttgcgcttccaaccgcggacctaccagtggtacgacgaccacggcctggcccgcgaactcaccgcgctcggcaccacgacgtgggtcgcctggacccgccagcgcgcggaggtcacccggctgtcccttggacagagcaggggcgaagctgagcagagtcaacggcgagacggcgacccgcgacacgaccgcttcatcgaagccctgcgccgcctcgaatgcgacggggtctcccgtgaccggtcgatacacttacgactcgccggcgctactcgctggcaggtggagatcgccgacggcaccgctcgcaacacacccgagcggacgttcgtggagcaggcggtgtcggctgttgactcggtgatccaggaccgatcgatgaagatggcacttctccgagccgagcacttcgacatcggcgtcccgagcagctggctcgatcgggtgcgatcacttcgcttccgatactgaaccccgtttctgcacgccgttcgtggatcaaatatccacagcgtgacccgccggcgcaggcgttccgtcagctcatgggcaaccgtgaacgcgtgggaaaacctcgaccgactcggcgtggaggcctggcggcattcgcctgccggttcccgacgaccactctggcggcgcttccgcgttgaagctgatcaagcgatccatcgagccgggccgcggtgccacaagaccgtcacccacggcgtcacatacggtgcgccgcgccgcgccgtcgggtgccgctgtaccgacacccgacggatcatgccactgattgctgacgcaggccacgacggcgctggcccgcggaaacgcaggtcgtaggctatttgaggagctgccgcgccatcacgatgcgctggacctggttggtgccctcatagatttgggtgatcttggcgtcgcgcatcatgcgctcgaccgggtagtcgcgggtgtacccataaccgcccaggatctgcaccgcgtccgtggtgatctccatggccacgtccgaggcgaagcacttggccgccgccccgaagtaggtcaggtcggcatcgccgcgctcgctcttgccggcggcggtgtaggtcaactggcgggccgcctccagcttcatgcccatgtcggcgagcatgaactgcaggccctggaactcggcgatcgccttgccgaactgcttgcgctccttcgcgtacgccaaggcgaagtcgagcgcaccctgcgcgatcccgatggcctgggccgcgatggtgacccgggtgtggtccagggtcttcatcgcggtggcgaagccggtgccctcggcgccgatcatccggtcggccgggatgcgtacgttgtcgaagtagacctcgcgggtcggcgagcccttgatgccgagtttcttctccggggcgccgaagctgacgccctggtcggacttctccaccacgaacgcggagatgccgcgggaccgggcggccgggtcggtgaccgcgaagaccgtgtagaactcgctgacgccggcgttggtgatccaccgcttgacgccgttgagcacccagtggtcgccgtcgcggacggcgcgggtggtcatcgaggcggcgtcggagccggcctcgggctcggacaggcagtaggagaacatgccctcgccggcggcgaccttggtgaggtagcggcgcttgaggtcctccgacccggccaggatgaccggcagcgagccgagcttgttgaccgccgggatcagcgaggacgcggcgcaggcccgggccacttcctcgatcacgatggcggtggccagggcgtccgcgccggcgccgccgtattcgaccgggatgtgcggggcgtggaaatcggacgagcgcagggcgtcgtacgacgccttggggaactctgcggtctcgtcggcctcggccgcgttcggagccacccgggcgtcacagacctcgcgcacggcggcacggatggtctcgtgatcctccggcagccggtagacgtcgaaatcagtcatcttcccttgcccttccctgaagcaacggtcccgcccgcaatgttactggcgcgtagcgtacgccgggcaacggaacctgactgtgccgaatatcgccgtgccgggttcggtgccgtttcaacagatctccacccggttgagactgttctaatgaagtggcggaccggcatgctctagctaccgagcgagagctagagggcgaagcgctgcgaggaggaccggtggcgaaggctgaggagcctgactacggcgagcaactgtctcgcatcgacgcctcgatcgcggcgctcaaacagcaggacatggaggccgcctccacgcgcaccaagatcgcgagcaagatccaggccgcccagttccagcgggacatcctggcgcacgcgcagaagcagaagaccgcccggccgcggggccgccgcccggccgaggagttcccgcccccgccgccgctagctagctagcgccgcccgccggccgccccggcagccgatggcgccgatggagcacggccccgaggcgtccacccagtcggtgcagaacatcctgctcggcctcggcgcgctgctgatcggcggcgccgcggtggtcttcgccggggtggccttctccaacccggtggcccgcgcggtgatcctggcgctgttcaccgcgatcgcgctgtcggtcgctccgggcgtggcccggcgcacgctgacctcgaccgccgagacgatcgcggcgatcggcctgatcgtgctgccgatgaccctctacgcgctgcacggcagtgcgctgggcggcggacccgccgtggccaccccgctctatctcggcatcaccttcgcgatcaccgcgatcgccggcttcctgtacgcgggcgccaccaaactggccatcccgcgctatgccaccgtgatcgccacccagcccgtcgcaccgctgctcgcgtacccgtggatccacagcccggccggctggggcctggccctgaccgcggtggcggtgctcgacctgctgctgctcacccgggtgctgcggcgcgggcggctggtgccgcgctggccgctgggccgaccgaccgccgccgaccgggccgccgagagcgagccggagtggccggagccgcgcccggagtcacagccggaagagcccgacctgatcatccccggcctcaggccgcgccgcagccgctggatcccgacccggatcttccccgggccgcggccggagggcgccccgccggccgggtccgtcccgctggccccgccggccaccccgccgtccgccgagtggctgcgcgagctcaccttcttcctgctctgcgtggcctgtgcgggggcgctgctctactcctcggtggcgctgctgcaggcgcaggtcgtgccggacgcgctgcgctccggcctgatcctggtcgccgccgcgctcaccgcggtcgccgccgcccagctgctggaccagccgctggcccggcacatcgccggcggcgtgctcaccctcgcggtgatcggcgcggcggcccgggtcgccgcggtggtcgacccacgctggacgctggtcgtcgcggccgccacggtggcgatcaccggcgccctcgtcggcatgctgccggcgcaggtcaggacaggtccgcagtacgcgtcgacggccgccctcgcgctgatcggcgcccgggtggcgatcgacgcgatccgtgccgccatcgccccggtggccgccgcccggccggtctggcacgccgacaccgcggcctacgcccgcaccctcagcgacgccgtcggcagcgccggctggctgctcgtcttcagtgcgctgctggtcaccgtcgcggccgcgctcgccctgcccggcgggatccggcacgagggcgcggtgatcggcgtcgcggtcaccgccctggcgctgcccgcgtccctcgccctgaactggtcggaggcgccctggccgctggtgctggcggcgatcgcgctgggcggggccggcctctggtcgagcacccggcgggtcgcgatcacgcacatcgccgcggccggggtggtggggctgttcggggccggtgccgcgctcgccgccacctggctcaccgcggcggtgctgaccgcgctcgccggcgccggcgtgatggtgaccatcgcggcccggcagatcccggtccggctgttcgcctggatggtcggcgactgggcgtccggcgcggccgcgctggccatcccgggcgccgcggtgaccgcggtgctggcgatcaccgacaccggccaggggccgccgccgaccgccgcggccaccgtcccggcgctggccgccggtttcctcacggtggccggcacgctcacctacgccgcggtgttccaggtggcccgccgcgagatcagtttcccgctgaccgccggcaccgggctgggcgcgctcgccctggccgccgccgccctgttcgcacccggccgggcgccggccgacatcgccgtcggcgcgctgctgatggccgccgcgctgctgctgttcttcgccaagagcatcgacgagcggggccgcaccgaccggatgatggacgggccggactgggccgcggcagccgccacggtggcgatctgcggggccctggcccgggtcgccgcgctcgccttcccggccgccccgctcgccgtcgccggtgtggtgatcctgctggtcgggatgggcgtcaccattttgcaggaggactggaaacgcgggccgtcccgaggtctgggcctggccgcgctggtggtcgccgggctggccgggttccaggcgatgggcggcagcctgcggatcctcaccgctcccggcccgctctgggccgcggacgtcacgcacctcgccgcggccccgccggccggcgcctggcaggccccgttcgcgctggtgatggtcgcgatcacggcggccatcgcgctgccccgaccgtggtcgcaccacgcctccggggtgtgcgccgcgctggccacgatgggtgcgccgtgggcgctcgggctgccctggtggtcgccgctgctgatcggggcggcagtggccaccgcgtacgcgctggccgctctcgccaccgccgaaccggccgcggcccgggcccgcgccgcggtcgccgccatggtgctgctgcacgcctccgtggtcggcctggcccgcccctggtcgaccgggatggcgctgctcaccgtcgtgctgctgggctctctggtggcggtcgccgcccgggtggccgccggcgaggccgacgtgctgcccgcccaccgggcgcaggtcggcggcgccgccaccgggtcggtgctgctcgccctgcccggcacgttcgccgcgttcgccgccgaccagggtggcagtgcgcaggtggtgctgaccgccgcgctggccggctccagcctcggcctggcgctgctcgcgctgctcggccggcgggtcccgcagtacctgccgtgggcgacgatcgggctggtgctgggcgcgatggtgaccgcgctggtctcggtgcccagttcctatccgacagcgttgtacgcggcggccgccgccctgctcggtgtgctcgccgagatgctgcgcggcgcggtgccggctccgctgcggccgagcgtggtcgaggagttcccggccggcgacatccgctatcagcgggcccgccggatgcgcggcggcggcggcctgttccagcgttggctggccgacccggccaccggtgcggtgatgctcgccctgctgcccaccgtgctggcgctgttctcgctggcgccggccctgcgcgccgccctggtcgacccgctcaagcagctcggctcggtctggaaagggccggtcccggccctgatcaccccggccgccggcaccatcgacgcgaccagcgcgctggccgcggtgctgctcaccggcgcggccgcgctggccgcgctgagcttcggcggccggcccgccgagaccgtcccggtgatcctgcccggggtcgccctgaccctgctgatcacgccgatcgcgctgcacgccgggttcccggcggccaccggcgcggccctggtcgtcttcaccatctcgatgctgggcctggcgctcaccctgcccccggtcgccagccgggcgccgctgctgcgcggcacccggaccgtggtgttcgtggtcggcctgctggccggcggcgccggtctcgccggcagcctggcccggtcccccctgaccctgctcaccctcgggtgcgcggtcttcgtcggggtggccgccgcggtcgccggccgcaccccgtcggcccgactgctgggctggctgttcgccgccctgatgggccagatgttcgtgctggccggggcgatcgcgctggggctgagccggcattgggccgcgttcggcgtgctcgcggtcggcgccggcctgctcgccctggagtcgctgctgccccggctcggtctggcgcagtaccgcgccgaggcggtcaccgtcgagtggagcgggtacgcgtcggcggcgatcgccggtgccctggccttcgactcgccggcccacctggcggcgctgctcgccgcctggggcgcggtgctgggcctgaccgcgtcccgaccggaccgcacgcccggccagcgccggacgatgttctggctggcggtcggcttcgagatcgtcggctggtggctgttcatcgcgctggcccaggtggccctgccggaggcgtacacgctgccgttcgcggcgctggccctggccgtcggcatcgtggaggcgcaccaccgtccggagctgtccagctgggcggcgtacggtccggcgttgctggccgccttcgtcccgtcgatcgcgctggtcctggccggtggcagccacaacgacctgcgtgaggtgctgctgctgctcggcggggtggtcacgctgatcatcgggtcgcgcagccggcagcaggcgccggtggtgatcggcacgatcgcgaccgtcgtggcggccttgaagttcgtcttcagcctgggcgggccgtggctgatgctggtcccggtcggggtgatcctgatcttcctgggtgcgacgagcgagagccgccgccgcaccacggaactgcgcaaccgggtgtcccagatgcgctagccgagcagtttctcccgcagggccgcgtccttctcgcccaccagcttttccaggccggcctggaagtccgacatcctctggcgcaatccggcgtccgaggatccgaggatccgcaccgcgagcagccccgcgttgcgcgccccgccgatcgacacggtcgccaccggcaccccggccggcatctgcacgatcgacaggagcgagtccatgccgtccaggtgtttcagtggcaccggcaccccgatcaccggcagcggggtcagcgccgccaccatgccgggcaggtgcgccgccccgccggcgcccgcgatgatcgccttgatcccccgcccggccgccgactcggcatagtcgaccatcttgcggacggtccggtgcgccgagaccacaccgacctcgaacggcacctcgaactcggcgagcgcctcggccgccgcctccatggtcggccagtccgagtcactgcccatgatgatgccgacgacgggtgccatcacttaccttcctgcagccactgagcggcccgcgcggcccgcgcgcgcaccgatgccaggtcatcgccgagcacggtgacatgcccgattttccggccgggccggacctgcttgccgtagaggtgcacccgcgcccccgggtcctcggcgaacaggtggtgcagccgctcgtcgatggagatgccgccgtcctcgccacccagcacgttcgccatcacgacgaccggggcggccagtgcggtggagcccatcggatagtccagcacggcccgcaggtgctgctcgaactgcgaggtccgggcgccctcgatggtccagtgcccggagttgtgcgggcgcatcgccagctcgttgaccacgatgccgtcgccggtctcgaagagctcgacggccagcagcccgacgacgccgagctcggtggccaggtcgatggcgagctgctgcgccgccagcgcccgctcctcgctcagcccgggtgccggcgcgaccacctcgacgcagatcccgtcccgctgcacggtctccaccaccggatacgccgcgacctgcccgaacggcgaccgcgccacgagcgccgccagctctcgccgcagcggcaccttctcctcgacgatcagcgggatcccggtggacaccaggtcctccgcggcctcgcgagaaccgaccatccagacgccgcgcccgtcgtagccgccccgggtcgacttggccaccaccggccaggcaccgcccgcgaacgcctcgatctcgtcggccgtgctcacccgcgaccagcgcggcaccggcgccccgagcgccgccagccgctcccgcatcatgcccttgtcctgcgcgaacaccagcgctttcgacccggggaagattttcacaccctcggcctcgagcgcctcgacatgctcggtcggcacatgctcatgatcgaaggtgacggcatcgcaccccttggcgaactcgcgcagcgcggcgagatcggtgtgcgtgccgatcggcacatcggccgcgaccagcgcggcggaatcgtcgggccgcgcactgagcacacgcagtgactggccaagggaaatcgcggcctggtgggtcatccgggccagctggcccccacccaccatgccgaccacgggcagaccggttcgggtatccatcgcccgcccagcctagcgacgccgctaccccaccgggaaatcaacccggcgtctacccacccgaggtcccccggtcccgcccggtccgccgcacccccacttcaagaccccgctttcgtacgacgtgagcagccccgccctcgccacgctcccgggcggtcggcggccggcgctcacgagcggaggcgcgcgaggaggtctttcggcgtggtgaccggacggtcgcagacgaagccgcggcagatgtacgccgtgggtctgccgtcgatcatcggccggtcggcgagcagcggcaccccggccagatcgggcggcccggcgacgaccaccgaaccggccggcgcctcccggaccgcctcgatcaccagcgggtcgtccaggtcgtcggtggccaccgcgatctcgtacggcccggtcagcgccgcctcggccaccatcgcggagtaaccggcgaaccgtggatgctccccgatcagcggcccggccgtcgccagcgccgcgtccgccgcgtcccgataccgggtctcgccggtcagcgcggcgtacgtcaccagcgccgcgcacaccgcggccagcccggacggggtcgcgttgtcggtggggtcggccgggcgggtcaccagtttctcggcgtcgtcagccgtgtcgtagaagccgccggaccccgtaccgaaacgggccagggcgacgtccagcaaccggccggccaaccgggaccaccgcggatccgcggtgatctgatgcacggcgaggaacgcctcggcgacgcagccgtagtcttccagcaccccggccgggtccccgacgacgccgtcccgggacacccgccgcagccgtccgtcgatcaggtgccggtcggccagcaccccggccagcgcgacggccgcctcgcgggacgccgtcgagccggtcagcgccccgtgttcggccagcgcggtgatcgccagaccgttccaggaggcgaccaccttgtcgtcccgggccggctgcggccgcttgccgcgggcgtcgagcagtcgggcgcggacgtcgcgccaccggtcgacgagcgccgggtcggcggcgtcgatgtcccgcgcgagcaccagcacgctcctgccgtgctcgaaggtgccgtccggggtgacccggaacaggtcggcggcccaggccccgtcgtccggcccgagcacctcggtcagctcggccggtgtccacgcgtaggtgagcccctcgaccccgtcggtgtccgcgtccagcgccgatgccagcccgccggccggagtcgccaggtcacggagcaggaactcggcggtctcgtcggcgacccggcgggccggcacgtccccggtgagtcgccacagctgggtgtagacccgcagcagcagggcgttgtcgtacaacatcttctcgaagtgcggcaccgtccagtgctcgtcgaccgcgtaccgcgcgaaaccgccggccagctggtcgtagatgccaccgcgcgccatccgttccgcggtgtgccggaccagttccagcgcctccgccgacccggtccgctcaaggtgacggagcaggaacagcaggttcatgtgcggggggaatttcggagcaccaccgaatccgccgtacgtctgatcatgctcctgtgccagcccggcagccgccgccgcgagcatctccgcggtgaccgccgcgaccggcccgcccacggcctgggccccgccgaccgcctggaccaccgcggcgccctgcttgagcaccccgtcgcgctcgtcgcgccaggccgcggtcaccgaggtgagcagccgggtgaactgctgtttcggaaaataggtgccgcagtagaacgggtcaccgtccggcgtcgcgaagaccgtcatcggccacccgccctggccggtcatcgcctgcgtcgccgtcatgtagacggcgtccacgtcgggccgctcctcgcgatccaccttgatcgccacaaagtccgcgttgagctgcgccgccaccgcgtcgtcctcgaacgactcgtgcgccatcacatgacaccagtggcacgccgcgtagcccaccgagatcagcaccggcacctcccgccgccgcgcctccgcgaaggcctccgcggaccactcccaccagtccaccgggttgtcccggtgctgctgcaggtagggcgaggtggcattcgcgagacggttggccatgcccccagcctctcacgcgccggcgtcacatccccggcaccggacgagctcgtcccaccacgtgccggccgacaccgctgagcggcccggcacgtttcccgtgccggaccgctcaacaccggtccgcaggtcaggccacgaaccgccggcgacggtgacgcgccatcaggaacaggccggcgccggcgaggacgacgatcccgcccacaacggcgaccgttccgctgttgctcccggtcaccgcgagcgcgggcgtcccggacggcgacgcgccggccggggcggcgacatcgctggacgcgccgggactgccggacgcggcggccccgggcagcaacccgacgaacgcggtggccgtctgatccgccatcacctccaccgaggtgctgtccgggttgtcgcccgccagtttgcgtccgggcacgctgacccggtaatcctgcgtcgccagcccggtgaaggacacccagcccttggcgtcggtccggccgccggccacccgcgcgccgcccggcttcggctggctgagcaccacctcggcgccggccaggcccggctgctcactgctggagtcccccttggcgtccacgaagaccttgagccgcatggtccccttgccgcccggcaccggcagccggaaggtgcccaggtcgtcagccgggtcggcgtcgcccgccgcggcctcgaactcgaagcggccggccgcgtacccgccgcgggatccggcgtcgctgaccttggcagcccaggtgaaggtccggctggcgccgggcgccagatcgaacgccgcgctccagggcatgtcgccgatccaggtcaggccgtcgtaggtgccgccggaccggatgccggtcgcggcgacggcactcacgttcctgatcgtgtagaccgccgtgatcgtgtcaccgaccgagtacgccgccttgcccggcgtgatggccaccgtcaccttgaggtcgggcagcggggcggcctgcgccggcccgacggccagcagtccggctccgagcccaccggtggccgcggtcagtgcggcgagaaaccgcccgggaacatgtccggtcctcattccgtcgttccatgatcaatcatcggagagcgaatggtatgacctggtcagagccgccgcgtccgccgaatgtgcggaccgtcaggacgcgccgtcggcgcgcagtggggtgatcgtggcctcgccggtggaggatcggcgcagctgggtgagcgcttggacgatcttgtcggcgggcatcggtttgcagaagtggtagccctgggcggacgggcagccgagggcgatcagcgcggcccgctgttcgatcgtctcgatgccctcggcgacgacccggacgccgagccgggcgccgagctcgaccgcaccgcggacgacggcgccggccgcgacggaatcgatcatctcgtcgacgaacgagcggtcgatcttgatttcgtcgaccgggacccgggtgaccgaggcgagtgaggagaagccggtgccgaagtcgtccagcgacatctgcacgccggtggcgcgcagccgggccagcacctcgtcgacgatgtcgcgttcgctgaccgcgaccgactcggtgatctccaggaccagccgggaggcgggcgtgcgatgccgccgcagcgcctcggtgacctgcgccgggaaggtcgggtcggtcaggctgcgggccgagacgttcaccgagacgggcacgtcgatgccggccgccgtccagtccgccgcggccgccagcgccaggtcgagaacccgccgggtgaacgggatgagcagctcgctgcgttccaccgcgggcaggaactcggccggggacagctgcccgcgccgcgggtgccgccagcggaccagggcctcgcagccggtcggcgcgccggtgatcagatcgaccgcgggctgcaggtgcagcacgatctggtcgtcggcggcgaacgcgtcctgcagctcggcgagcagggccagttggtcggtgctgctggcgtcctgaccgctgtcgtaggtgccgacggtgagcccctgctccttggcccgcccggcggccagcgacgcgcgccgcagcagctcggtcacctcgacgtgaccggcttgggcgaccaccgcgccgacggtcacctcgacggccagccgcaccccggccacctgcatcggcagccgcagctgctcgaccagctcgcgggcccggcgcagcgcctgggagaggatgtgcggggcgccgcgggcccagccgtccggcccggccagcgcggtcagcgccggcatcagcagggcgaactcgtcgtcaccgatccgggcgacgagctcgccggcccgggcctggccggtgagccgctcggcgatcacccggagcacctcgtcgccgccgcggtgcccgagggtgctgttcacctcacggaaaccgaccacgtcgagcagcagcagggcgaccgggcggccgcgttcgccggagcgcagcacggtgtcgccgtcggcggtcagcgcgggccggttgctcagcccggtcagcgggtcgtgcacccggtcgtgggcgaccagcgcgtccagctcggtgatccgctgatgggcggccgcgtcgtgcagcgccccggccagagcctcgccgtacgccgtgatcgccgcctcgtcccgggcggccggcagggtcggctcgcccagccagacggtgagctcgccgaccgggcggccggcgaccgccatgccccgggtgaccgccgggccggagcgggccacgtccgggttctgtcccgggccgtcctccgcgtaccgccggctgccctgctcggagcgcagctccagttcggcccgccgggcgccgaacacgtcgagggcgccgcgcagcccggcccgggcgacctcggcctcggtggtgccggggagccgggcggtggccgccgcgaacgcctcccacatccggcgttcctcggcggcacgcaggtggaaccggtaggtgcggtgcagcaaccagagcaccgggccgaaggcgagcagccagagcggctcgcggaccagggcgtagaccgcgcacacgccgacgatcacgttgccggtggacatcggcaccttggcgtacagcaccctggtggcgagctgcgccggtgcggcgtcgcgctgcagggtgagggtgagcaccaccaggccgaaggtgatcagcaggtaggtggccgcgccggcggccagggccggcaccagccgcccgctgcgcaccccggcgtcgccggccagcagcgaggtgaccagggcggcggcggagacgcccagggtcatcgaggcgaccaggtggaccacctcggcgacgttgcgcaggccggtcagccaggcgagcaggagccaggcggcgccgatgccgaccagggtggcggccgggagccagccggccgggcagaccaccagcccgaccacgacggccgcctcggcccagctcaccgagaccgcgtccgggccgagccggaaacgcaggccggccagctgggcgatggccgccaggacggccgccacgcagccgccgtcgaacggcgtgagcgggctgtcggcgcgcaggtgggccggttgcagcgcgccgagcaggacggccgccagggccgccaccacgacggtcacggtgaggacccgcaccgggcgggagcggccggcgagccgggtccacgcccgacggtgcgccgcggagcgaccggtcatgaccgggtcccggaacgcgcgggacgatgcacgtgcagatgcggaagccggaatcggcgccggagtccactcatctcggcgcccccttccgcgcagggtccaggaggccgtatggcccccggcggaaggctaaatcaatcccgatgaacgcaacagggcttgacgccgggccggggacgacactcgccgcccgccatcgtcggacggaccggcgcggcaggcagcgggccgatcatggggcggtgcgcccggagtccgatgcggactcgtgtttctcctccggcaccgccgccacctcgccttccgcggggtcggcgaccttgggcgatcgatccgcttcgacgcggaccggcgcctcggtgccggaccgggcgagatccgcattgagccgcgcgatttccgccacacgctcgcgctcggcctcatccgagaaactgtcgggaagccgacgaatgcgcttgttcatgttgcggatcaacagcacggtcgctatgcacatcaggacgatcaggaacaggcccatcggaccggccaggccgccctcacgggtgtccccgaagttgttgaccgcgataatgtccacgcccccaagcctactgctcaggcggcgtcgaccttctcccggatgccggcgaacaggtcggactccggcaccgggctgtcgaccagcgagcgggccagctcgaagtcctcggtgggccacaccttctgctgcatctccagcgggatgtggaaccagaagccgtccgggtcgacctgggtggcgtgcgcgcgcagcgcgtcgtcgcggaccgcgaaatactcgccgcactcgacccgagtggtgatcttgtcaccccggtcctgccggtcggaccatttctccagccactcggcgtacggcgagtccagccccgcggcgagcatcccctcgtgcagcgcgagcatccgcgcccgggtccagccggagttgtagtacagcttcagcggctgccacggctcgcccagctccgggtagagctccgggtcgccggcctggtcgaaggcgatcaccgcgaccttgtggcacatgatgtggtcggggtgcggataaccgccgttctcgtcgtaggtggtcatcacgtgcgggcggaactcgcggatcagcttgatcagcggtttcgccgcctcgtgcgggtcctgcaggccgaagcagccgtccggcagcgggggcagcgggtcgccctcgggcagcccggagtcgacgaagccgagccaggcctggtccacgccgaggatctcgcgggcccggtccatctcccggcggcggatgttggtgatgtcggccagcacctcgggccggtccatcttcgggttgagcacgctgccgcgctctcccccggtacaggtggcgacgagcacctgggcgccctcggcgacatatttcgccatcgtggcggcacccttgctggactcgtcgtccgggtgcgcgtgcacagtcatgagacgcagttgctctgccacgttgattaccctctcgaccaggcctgccgtcggcgggccgggaccggctgcgaagatggactctgccattctggccgatcccccggacaacaaacgcatgagaggccgtcaggtgagcgagacgcgcgccacaaccccggttttcccgcccggccggtacggccgtcgtcgggagcccggccggcgccgcccgctcggactggtggtggccgcggtcgtgtgcggtgtcctggcccttgggctgacctgggcttattatcagaaattcggccgtacggactacagcccggagatcgtcggttggaacgagccgaccgacaccgagatggtgatcaagttccgggtccgggtgccggccggcgagagcgccgcctgcatgctgcgcgcccgtgactaccagggctatgagctgggtacccggacggtcaccgtgcccgcgagaccgggcggcggcgagatcgtggtgaccgggtcggtgccgacgaccgcgcgcggctcggtcggtgacgtgatgagttgccgccccgccggctgagtccggccggccatcgaccgctccggcgccatgcgtaccgctggtaaggttggtgattcgctgcgttcaccgcgcacccatttcgtgcactgccgttcccgcttttcgcactttccgtccagcaaggagatcgaccgtgtccagttccgaggcgccgaagacctggctctcccaggacgcatacgaccggctgcaggccgagctcgacgagttgatcgctggccgcccggcgatagcggcggagatcaacgctcggcgtgaggaaggcgacctccgggagaacggtggctaccacgcggcccgcgaggagcagagccgccaggagggccggatcctgtacttgaaggagttcctgcgcaactccgaggtcggcgaggtgcaggccgccgacagcgtggtgcccggctcggtcgtgacgatctacttcgacgacgaccaggccgacaccgagacgttcctgctcggctcgcgcgagatctcctcgaccaccgacctcaccgtgtactccccggagtcggcgctcggcaaggcgatcctcggcgcccgccccggccagaccgtgacctacaccgcgcccagcggtgccgacatcaaggtcaccgtggtcaagttcggcgccttcgagggctgaggccgctcccgggcgctgagactcaccaggtggcgacgagctcgcggcgcaccgattcgtaactcgccgcgagttcgtcgtccatccgcgcctgctccggctcggtcatcacgaccgcggccggttgcgccgggcgcgccgcgagcagcccggcccgcagcccgtccggcgggtgggtggcgaacaccgacaccccggcccgcctgctcagctgccggtacgccgccagtccggtggcctggttgacccgtgcctgatcggccgccgcccgccaggccgccgcgccgttaccggcccgggcctcccgccgggtgacggtgtcgatgccgtcggccagcaggaacacgtcgatcatccggatcaccgccgcgctgccggccaccttcgccgccagctcgtccgccaggtactcagcccgctgtgagtcccggcggctgatcgagaccagcagcaggtgcagcagcccgatcagctcggcgaggatgccggccaccacgtcgaccaccgactccgcgatcatgccgatcaggttggaggtcccggcgctgccgcgggccggtcgcaccatgccgcgccgcgcgtccgggcgcagccgggtccgctgcaggtccggccgcagcaggtaggccacctgacccagcgtgctctccacagcctgggtgagcaggcctcggcggacgtccccgttcacgaagtggccgagctcgtgaccgagcagcgcgacccgctcctggggatcgagcacggcccacagcggggcgcccaggcgcagcacccgccggcgacgcagccccaccgtggtggtggacgcgttgaactcgggagtgaacaccaccacgtggggcatcggcgtgccggccgccgcggccacccgctcgatcaccgcgaacagcgtgggcgcggtgtcacggtcgagctgccagccgtctcggatcagcccggacagccggcccagccggggccgcagcaccacggcgatcaggatcagcagcgcgccgatcaggttgagcggctcgaagaagtcgtggacgagcaacccgacaccgatcaccagcagggccgcgacgacggcgagcaggggcaccgcgagagcgatggtggcgatccgggccgacgtcgccgcccgggcgagggccggcgcctcccgcagctcggcgtactggctctcggtcagtcggtacgcggcccggaacaaccgccggtccagccaccgccagcccatctccggcgagcgctgcccgggatcgaagcagtccaggttccattcacaagccgggcaccacggctcggccgaccgccggctgatcgtttccgtcccgcacttcgggcagcccgccccgatcgacaccactgacacgagcggagatcatccagggggtggcgggaagcggcaaccccggtcagggggtggcgtcggccagcagcgccacccgatatccggcgtcgcgcagggcgctgatcagcgccgccgagtgggccgggccgcgggtctccaccgacagtgccacctccacctcgccgaagctcagccgcgggctctgccgggagtgcaccacgtcgacgatgttggcgcgctgctcggcgatctcccgcagcatccgggccagctgcccgggccggtcggtgcagcggaccgcgagccgcaggtaacgcccggccgaggcgagcccgtgctcgatcaccttgagcagcagcatcgggtcgatgttgccgccggacaggatggccaccaccgggccgccgccgcgcggtggggtgtacgccccggtgagcagggcggcgacggcggccgcaccggccggctccaccaccatcttgtgccgctccagcagcaccagcagggccgccgacaggtcctcgtcggtgaccgtgaccacctcgtcgaccagtttcgccacgtgcgcgaaggtcaggtcgccggggcggagcacggcgatgccgtcggcgatggtggcgcacgactccagtttccgcggcgcgccggccgccagcgagggcgggaacgcggccgccccgctcgcctgcacgccgatcacccgcaggtcggggcgcagcgccttggcggcgaccgcgagaccggagatcagcccaccgccgccgaccgcggtgatgatcgtgctcgcctccgggcactgttccaggatctccagcgccagcgtgccctgcccggcgatcacgtcggggtggtcgaacgggtggatcagcaccgccccggtccgccgggcgaagtcgccggccgcggcgagcgcgtcgtcgacgctggtcccggcgtactccacggcggcgccgtaccccttggtggcgctgaccttgggcagcggcgcgccctccggcatgaagacggtggccttgatgccgagcagcccggcggcgagcgccaccccctgggcgtggttgccggcgctggccgcgaccacgccgcgggcccggtccgcctcggagagccgggagatccgggtgtacgcgccacggaccttgtaggagccggcccgctgttgattctcacacttgagccagaccggcaccccggtgatctcggtgagcggccgggaggtcaccagcggcgtggttttcacgacgccggcgagcaggtcccgggccgcttcgacgtcggccagggagagcaggtcggtcatgggcaccaatcgtgccactcagcccggcgagtgccgcatcacaccagggcgtgacgctgccaggggttctgcagctcgaactggccggccaccgagagcagcagcaactccgagtcgggcgggccgaccagctggacggccagcggcagcccgtcatccgggcggaagccgaccggcaccacgatggccggcaacccggcgaagttccacggtgcctgatacggcgcgtaccgggcgttggcctgcatgttctgcacccaggacagcgacgagaaggagagcgcccgcggcggcgtggcggccagcgccggggtgagcagcagatccacgttgcggtcggcgaagaaccggatcgaccgctcgcgccaggccgcccgctggctcgcccgcaccagcccggccctggtcaccgcacggcccagccggatgtgccgctgcgtgcggggttgcagggacttcagatcaagaccttcggagttcttgtacgcgccggcgaaccacgtggccagtacccccagcgccaccccggtggggtatcgcggatcggcgtgcaccgtgtcgtgcccggcgtcgaccagcagcttggacgccttggtcacggccgacacgttcggctcgtcgggtttgaccccggccaccggggagcgcagcgacaccccgatccgcagccgggccggctcgaccagtttcgcgggggcctgaccggccagcacgctgaagccgagcgccgcgtcggccaccgtggtggtcagcaccccgttctccaccaggccgaaccagtcgttggccccgaagtcgaccggcaccacgccgcggcccggcttgagcccgaccaggccgcagcaggccgccgggatccggatcgagccgagcccgtcgttgccctgggcgatcgggaccagcccggccgccaccgcggcggccgagcccccggacgacccgcccggcgtacgatccagatcccacgggttgcgggtgggcccctccgcgtcgtcggtgaccgcccagaggcccatctccggcatcttggtgaccccgacgaccaccgcgcccgccccgcgcagccggcggaccacctcgtggtccacctcggccacctcgccggtgcgggccgcggccgagccgtgccaggtcggcaggccggccaccgcggtgttctccttgaccgcgaccggcaccccggccagcggaaggttcgccaggtcctcctggtcgtcgaccttctccgcctcggtgatcgcctcaccgccgcggaccacccggaacgcgccgagtgccgggtcggagatggcgatctgttccagatggtcggccacgacctgggtggcgttggtgtccccgcgccgcaccgcccgggcgatctgcttggcggtggcgcccacccaggtcgtcgtgtccatctgccgattctcccgctgttgaagccttagccgagcgcctgctcgaggtcggcgagcagatcgtcaacggtttcgatgccgacagacagtcgcacgagatcggcgggaacttcaagcgctgagcccgcagccgacagatgtgtcatctgcccagggtgctcgatcagcgactcgactccgccgagcgactcggcgagcacgaacagcttcgtccggttgcagatctccaccgcctgctccgggccgccggccgcgcggaacgacaccatgccgccgaaccggctcatctgcttggccgcggtctcgtggccggggtggctctccagccccgggtagagcacgctcgccaccttctcgtgctcgctgaggaacccgacgatccgctcggcgttgtcacagtgccggtccatgcgtacacccagggtcttgatcccccgcagcgtcagccaggcgtcgaacgggccgttcaccgcgcccatcgcgttctggtggaaggccagctcgtcgccgagccccgggtcggccaccaccagcgcgccgccgaccacgtcggagtgcccgcccaggtacttcgtggtcgagtggatcaccacgtcggcgccgagcgcgagcggctgctgcaggtacggcgaggcgaaggtgttgtccacggcgagcatcgcgtcgtactcgtgggccagcgtcgccagggtggtcacgtcggcgatgttgagcagcgggttggtcggcgtctcggcccagatcagccgggtgtgcccgggacggaaggcggcccgcaccgcgtcgaagtcgtccagcgggacggcagtccagtccaggccccagcgctcggcgaccttggagaacaggcggtacgtgccgccgtacgcgtcgttcgggatgacgacgtggtcaccgggccggcagaccgcgcgcagcagggtgtcctccgcggcgagcccgctggcgaaggccaggccgcgccggccgccctcgatcgcggccaggcactcctggagggcgtcccgggtcgggttgccggaacggctgtactcgtagccgaggcgcggcgcgccgaccgcgtcctgcgcgtacgtgctggtctggtagatcggcggaaccaccgcgccggtgcggggatccgggtcctgccccgcgtggatggcgagggtgtcgaacccatagtgatcggtagtcatgtaacgcaaggctagtctcagtccgtggccgactgcgtgttctgtgggatcgtggcgggcgatgtcccggcattcaaggtcgccgacgaggcggccggggtggcgtttctcgacaccaggccggtgttcaaggggcacgtcctggtggttccccgcccgcacatcgtccagttgaccgagctgccaccggcgctcctggaaccctatttcggattcgtccggagcatcgccgcggcggtgcccgcggccctgggatccggcggcaccttcgtggcgatgaacaatctcgtctcccagtcggtgccgcacctgcacacccacgtcgtcccccggaccaggggcgacggcctgcgcgggttcttctggccccggcgcaggtacgactcggacgccgaggccgcggagatcgccggaagcatcggtaaggaattgcaccgcgccggtgttacagacagcggacgaagggagtgaccgtgttcctgcggcacaagaagctggacctgcccaccgccgagaccgccctgccgggccggctgatctcgatgccggtcgccgacaggcacgaggttctcggcaccccgctggagggcccgtggccggccggctacgaggtcgccgtcttcggactgggctgtttctggggcgccgagcggatcttctggcggctgccgggcgtccactccacctcggccgggtacgccggcggtttcaccgcgaacccgacctacgaggaggtgtgctccggcaccaccggccacgccgaggtcgtgcaggtggtctacgaccccagcaagatcagttacgcggagttgctgaagaccttctgggagaaccacgacccgacccagggcatgcgccagggcaacgacgtcggcacccagtaccggtcgacgatctacaccaccacggacgcccaggcggaggccgcgcgcgcctcgctggccgccttccagccggtggtcaccaaggccggcctcggcgagatcaccaccgagatcaagccgctcggcgactactactacgccgaggactaccaccagcagtacctggccccgaccaagaaccccaacggatattgcaaccacggccccaacggcctgtcctgcccgatcggggtcgccaagaccgaaggctagtcattcggtcgccttcgggtgtgcggctcgccgccacccgtgggctgcgggccgagtgagaggtcacggcgagattcacgctgtcgggggtaaaaaatcgacatgtcccgaaatcctgcccacactcgaacgtgagacacgcgggaggtggatcatgtcaccgagttcggcgaacgaggcacgttattccggatatcgcgatgccggcgagcgcttccggaaccccgacgagcacgacgcctgggcgcaggccgaggtcatgatggaacaggcccgggccatgatgcgcgaggccgaggacgcgctggagacctggaagaccggcaaggagatgaaccggctgcgctgcgagcggcgggggatcagccagaccgacgcggagatccggtggtcggcgacgacgaccgcgaagaacgcgatcacgaacaacaacttctacgtttcgctggcgtcgatgtattacggggcggcgtccgcgaattactcacgggcgctctatctccgcagccacggcagcgcccggttctgaaccgcccgggcgcggcgggcggcccacgatccggtgcagaccgggaaacggctgagcatggcgagcggctcggcgccggccgggaaacggctgagcgcggcgagcggctcggcgccggccgggaaacggctgagcgcggcgagcggctcacggcgtacccccatcgcgcggagcgccggaaatgccgtaggtcgcggatcggtgccggggatcgacggtctagcggtccggatgggggttgtcgcgctccgcgaccggcgtcgtgtccggccgggtaggcgccgcctgagccggattcgccggcgcgaccagcgtcagaccgagaaccgcccccgccccgatgagccgcagacccgcgagcgacaccgggcgacgttccgacttctccatgaacaaactcctcacgaccgggtaccgaccaccaccgtgccaccggaacctgagggatcgctgtgtcaaaaccgtgcggacgggcaccattgatcgggtggagaccgcgaccgagaccgagcgcaaatatgacgttcccgagaccttcgagcttccggacctgaccggcgccgcgggcatcgcccgggtcggcggcgccgagacgcatgatctcgacgccacgtatttcgacaccgaggacctccggttgatgaaaaatcgtcggacgcttcggcggcggtccggcgggcacgacgccggctggcatctgaagacgcccggcgacggcgacggccgtcgagagcaccggatgccgggcgacggcgatcaggtgccggacgagttgcgcgccctggtccggacactggtgcggcgacgtgcgctggaaccggtggcgcggctgcgcacgcatcgggtggagacgccgttgcgcgatgcggaagggcgcacgctggcgctgatcgcccaggatcgggtgcgggccgattccggcgacgagcacagcgcctggcaggaggtcgaggtcgaactcgtcgacggcgacgagcgcattctcgacgtggtcgagaaggccctgctcaaggcgggcgccacgcatgccgcgggaccgtccaaggtgacccgtgccctgtccgggcggctttccggaaagccacgtcccggcaagatcaaccccatttcccggtacgtcgccgagcagcgcgacgccattctggaacacgacccggcggcccggcggggtgaccaggacgccgtgcacaggatgcgggtggccacccggcggctgcgcagcaccctgaaaagcttccgccgctggttcccggatcgggagaccgccgggctcagcgacgagcttcgctggctcgccgcggcgctcggcgcggtccgcgacccgcaggtgctggagggcaggctgctcgccggtctcgacgacgacgccgcgttcatcccggccgcgcagcggatccgcaccgccctggacgagcgggtcgccaccggccgcgagcagctggccgcggccctcgactcggatcgctacctggacctgctggaccggatcgacgcgctggccgaccacccgccggcgcgcgccggcaacccggcgaaacaggtccgcaaggtgctcggccgggccgacgatcgactggacacggcgctcgccgacggcgtcgacgaggagttgcacgaggcccgcaagaaatacaagcaggcgcggtacgcggtggagctgatcgccgcggattccggcagaccggccaagcggctcgtcaagacgctcaccgccctgcaggacgggctcggcgcgcatcaggactcctcgatcgctcgggaaacactgcgtgaaatcgggccggacagtttccatttcggcgttctctacggtcgacaggaagcagtgggtaaggagacgctcatcgccgtccccgcactggtgcgggcgtcacggcgcaagaaggtccgtcgctggctggtgaaggcgtgaggcaatgagcactgaggtggattcgcagttcgacgaggcggtgacgcacccctatcagggtccgatcgccgagctcaacggttaccgggtggtggacgacgaggatgacgacccgcggctgctgaacgcggacggcagcccggtcgacacctggtgcgaggactatccgtacgacgagcggctcgcccgggccgaatacgaccaccacaaacggctgctgcagatcgagctgttgaaactgcagaattggtgcaaggacaccggggaacggctggtgatcctgttcgaggggcgggacgcggccggcaagggcggcaccatcaaacggttcatggagcacctcaatccgcggggtgcgtcggtggtcgcgctggagaaaccgaaccagcgggagagcacccagtggtattaccagcggtacatcaaacacctgccgtcggccggtgagatcgtgctgttcgaccggtcctggtacaaccgggccggcgtcgagcgggtgatgggtttctgcacccgccaggagtacctggaattcctccggcagaccccggaactggagcggatgctcgtcaactccgggatcaacctggtcaaattctggttctcggtgacccagaaggagcagcacacccgcttcgcgatccggcaggtcgacccggtccggcagtggaagctctccccgatggacctcgaatcgctcgacaagtgggacgactacaccgaggcgaaggaggcgatgttcttctacaccgacaccgccgacgcgccgtggaccgtggtgaagagcaacgacaagaagcgcgcccggctggaggcgatgcggcacgtgctgcaccgcttcgactacgccggcaaggacctcgacgtggtggcccggcccgacccgctgatcgtcggcccggcgtcgctggtggtggagagcgccgagtccggcccccgggtattcccgcgactctagtgattcaaaaccgttggcgcggacgtccgcggctggttaacgtggccgtacacgtgaagggaggtggtccgaagttgtatagcaacgggactcgtgaggtggctgtccgctagccgctgtccttgacagcttcgttttgagcgtcgagaccgtgtggcagcggccggcgagtaccagacagccacccgacccccggggatccggccttgtccgaccggacctcgctcgttcgcgagcgaggaagtccccgggggtcgcttaatttcagggacttccgatgcgtgagctcgtcgtgctgggaacagccagccaggtgccgacccggcatcgcaaccacaacggttacctgctccgcttcgacgacgaggtgatcctcttcgacccgggcgagggcacccagcgacaactcctgctggccgggctcgcggtcaccccgctgcgccggatctgcgtcacgcacttccacggcgatcacagcctcgggctgcccggcatcctgcagcgcatctcgctggaccgggtgccacacccggtggcggtccactatccggccggtggccaggagttctacgaccggctgcggcacgccacgagctactgggacaacgccgagatcgtcgcttcgccggtcggcgccgggttcgcggtggagacgtccgcggggcgcctcacggcgctgccactccggcattcggtggagtcgtacggctaccgcctgaccgagtccgacagtcgccggatggtgcccgccctgctcgccgcgcacggcgtgaccgggccggccgtcggcgagctgcagcgggccggtcgcctcggtgacgtgacactcgaccaggtcagcgtggtgcgaccggggcagagcatggcgttcgtgatggacaccggcctgtgcgacagcgtgtacgagctggcccgcggggtggacctgctggtgatcgagtcgacgttcctggcggaggatgccgcgatggcggcccaggtcgggcatctgaccgcggggcaggccggggcggtggcccgggagtgcggggtgcggcacctggtgctgacccacttctcgcagcggtatccggatccgtcgcggttcctcgacgaggcccgggacgagttcgccgggccgatcacgatcgccgaggacctgatgcgggtcccgttcccggcgcgccgggacgcgccggtcgccgacaccgggttgtcacccggcggtcgctaacgtctccggcatgaagcttcagctgcgggccgcgggggccgacgatcagttccgggtcggggcgctgcaccagcggtcccgggtggcggcgtatgcggggttcatcccggtggaggtgctcacggcgcggtccgccgagtcgttcggcgagtggtgggccgagcgctggaaatgggagcaggacacgcaccggatgacactggccgaggtggacggcgagctggccggattcagctacatcgggcccagcgagactccgcgggcggctgaactctatgcgatccacgtcgatccggcccgggtcgggaccggggtcggccgggagctgatggtccgcgcgctggccgacctgccggcgatcggcgaggctcgggcggtcctgtgggtgctgaccgagaatcatccggcccgtcggttctacgagcgcggcggctggacgaccgacggagcgacccgcaccgagccggtcaacgatgtcccggtcccgcaggtgcgatacgaacacccgctctgaccgtgacagcccgccaccgagcggcggcgggctgctggttgagcgggaacgcgtgaccgatgaatgcgggggaacctgtggtcacgcgctcccgccaaccgccccgctcgaaccggttgcgcctggccggaggcgcggatcagcggaggcgtgccgatccgtggtccggttcagaagcgggcttgggcgcgggaataccggagcgctggcggggcgccccggcgtcaccgccgggagacgtacgccgggccggaagccaaggcttgccgggggacggtcaagctcgtcggcgacgtccaggtctggatcagtcggcgtacctccgatggttgtggttgccgcggtccgcgcgacccctgtcggtcatcgcggcgggcaggctgttcaagtcgtgtcgcagggtccaggcctcgcgccagggtcggcgggacaccgcgtcggcgcgttctgccaggcggcgggccgagcacggccagtgccatccacaccagacgcagttgccgtcccgcccggcggccatatgccggccgagcatctgctgcgcgtcccgccacagcaggcggtccacgatgtcggctggcgccgcctcgtcgacgtcgaccatcccctaccccttcgtccgggagtggctcatagctccgtcacgacacatacaaccgcatcccccggttccccggtcggactgagtgtgcgattgcggcgactatccgtaaccgccgatgtccactgtgttccgggtcgacgccgcgcatccacctccgtgaccgggccgacaccacgttcgccctgggcggacgcggtgccggcatcgacgggcggacgagcggtgttgaccgggacatggacaccgaagaatccgaggcgctcgatgcctacagccgcatcgtcaccggtgtggccagccgtctcctgccctcggtggcggcactcacgatccgttctccgcgtggcggcgccggatccgcggtgaccttcaccgacgacgggttcctgctcaccaacgcgcacgtggtggccggccccaccaccggctcggccgcgttcgccgagggggtggagacgccgttcgacgtggtcggcgccgacccgctgtccgacctggcggtggtccgggtgcatcaccccggcgcgccggccgcaccgctgggcgacgccgacaccctgcggatcggtcagctcgtggtcgcggtcggcaatccgatgggcctggccgggtcggtgaccgccggcgtggtctccgggctgggccggtccctgccggcccgggacggccaccggatgcgggtcatcgacaacgtcatccagaccgacgcggcgctgaatccgggcaactccggcggcgcgctggccgactccgccagccgggtggtcggcgtcaacaccgcggtcgccggatacgggctgggcctggccgtgccgatcaacgacaccacccggtcgatcatcggcgagctggtcgccaccggccgggtccggcgggcctggctcggcgtggccgggctgcccgcgccgctgccgccacacctggccgggcggctggggcagaaacaggggctgcgcgtcgtcgaagtggtgccgggcagtccggccggggtcgccggcgtctacctgggcgacatcctggtgagcgcgggcgggcatccggtcgactcggtccaggccctgcagcgcctgatgctgggcccggccatcggcgtcgacctgccgatcaccctgcttcgccgcaacgccctggtcgacgtcgtcgccgcaccggccgaactgcgctgaccaccctgcccgacgcacagccgggtcgacgccgtcgcggggccgggccggccgggcggcggttgaacgagtgccggggcgtggcgatcacgtgcggtgggtcgggtggttcgtcggctccgggatgttggcggtccgggccgacgaaccactgcacagtcagctcaggtgggcgagcaggtcctgtcgggtgaggacgccggcgggtttgccgtcgaccaggaccatggcggcgtcggacttctccagcagggcgaccgcgtcgctgacggactcgccgccgccgatcatcggcagggggtcgcccatgtggcgttcgatcgtgtcgtgcaggtgggcctggccggtgaagagggcgtcgagcagggccttctccgagatcgaaccggccacctcgccggtcacgaccgggggttcggctttcaggacggggagctggctgaccgcgtactcccgcatgtagtcgatcgcgtcgcggaccgtctcggtggggtggacgtggaccagcggcgggatctcggcgcccttggcggcgagcgcgtcggccacggtgggtgcgtcgccgggggtgcgcaggaaaccgtagcgggccatccaacgatcgttgaagatcttggaaaggtagccccggccgccgtccggcagcaggaccacgatgacgtcgtccgggccggctttgcgggccacgtcgagcgccgcgaccacggccatcccgcacgagccgccgaccagcagaccctcctcgcgggccaggcggcgggtcatctcgaacgagtccgagtcgctcacctcgatcacctcgtcggtgatctcccggtcgtacgcggtgggccagaagtcctcgccgacgccctcgaccaggtacggccggccggtaccacccgagtacacggagccttccgggtcggccccgatcacccgtacgcccggattctgctctttgagatagcggccgacgccggtgatggtgccgccggtgccgacccccgccacgaagtgggtgatcttgccctcggtctgtttccagagctcggggccggtctgctcatagtgcgagcgcgggttggcggggttgctgtactggtcgggtttccaggccccgggaatgtcccgggtcagcttgtccgagacgttgtagtaggagcgcgggtcctccggggcgaccgcggtggggcagacgacgacctcggcgccgtacgcccggagcacgttctgcttgtcctcgctgaccttgtcggggcagacgaagacgcacttgtagccccgttgctgcgccaccagggccaggccgaccccggtgttgccactggtcggctcgacgatggtgccgcccggcttgagcaggcccgcctcctcggcgtcctgcaccatccgcagggcgatccggtccttgaccgaaccgcccggattcatgtactcgaccttggccagcacggtggcactgatgccgtcggtcacgctgttgagtcggaccagcggggtgttgccgatgatctcgaccacgttgtcgtaatagcgcacgcttcagcgtacgacgacgggcttcgccagcctctcccactccaggaaccgctcggtctcgctgagcacggtgccggccagccaggtcaccatcaccgcgtcgtcgatcagcccgaagacccacaggaaggcctccggcacggcgtcgatcggcgagacgacgtacgcggtggccgccgccatcagggcgagccgcatgccgccgtcgtactcccccctggtggtcgctttgaccatgcgaggcagcgccgagatccgtttgctcagcgacgggccaccgcgggcgccggacatcagcgcccggcccagtgcgctgaacgccgccgcacgtttcagagttttcgccatctctgttcccctttccgcaactccagcatgacttgggtacgccatgattgcccctcgcgagaccgagttagcctcgaatcccgacgttgggtgccgatcatggccgcaccgggaggcgactccgggccggttggttcccttcggacgacagcgagggacactgtgaacagcactgttatccacttccgcggcctgaccgccgaggaccggcagcggatccgtacggccggccggatcgccggccaggtcaccggagcactggccggcgtcaccgcgatctcggccggcctactgctgcggcaggccgccgacgcccggcggatcatcccgctggccgaggcaccgccgccccgcggcgacgggatctacggagcgaagttccacggcaggccgatcagtctggccgtcctcggggattcgtcggccgccggttacggcgtgcaccggccccgggagacgcccggcgcgctgttcgccaccgggatctcccgccgcctgcagcggcccgtccagctgcaccggttcgccgtcgtcggatgcgtctcgtcgggcctgccgtggcaggtcgacgcggccctggagcaccaccccgacctggcgatcatcctgatcggcgggaacgacgtcacgcacgtctcggcccgggccgaggcggtccggcacctgggcgacgcggtccgccggctgcgcgaggcgggctgcaaggtggtggtcggcacctgtccggacatcggcgcgatccagccgatcaagccgccgctgcgctggctggcccggcgatggagccggcaactggcggccgcgcagaccgtcgcggtggtcggcgccggtggccgcaccgtctcgctggggaatctgatcggcccgatgttcgaggcggatccggcccggatgttcggttcggaccgtttccacccgtccgcggaggggtacgcgagagcggccgcggtgatgatgccgacggtgatggccgcgctgggcgaggacgaccggcccgcggtgccgctggccgagtcggtgcggacgttgccggaggcggccgtggaggcggttcgggcgccggggaccgaggtcagtccggtgcggtccggcaagcggtgggcgcagttgcggcggcatccctggttcggggagcagcgccactggttcgggtcgttgagcgcccggtcggtgccgcagccgcaggctccgggtccgatccgggcagcgagttagagaccggatgcgatccgcgccgtagggtaaagaggaagaaggatcatcgaagtcggcgggaacctcggacttagcaagcaccgggaggcgggacatggctgggctgccggaacgattgaccagggccgcggccacgagcctgctcgccggcgcgctgggcggggccgccctgctcgccggtgagatgctggccgccaaggcgcgccgctacgccaagcccaccatgggtctggcgctgcgcacctcgatgggcccggtgaccgccccgccgctgcggctggtgctgctcggcgattcggccgcggtgggggtcggcgtggagtggctgtccgacacggtcggcggccaactggcccggctggtcgccgacggcaccccggagaccggcccgcggcacgtgctgctgtccagcgtcggtgtggccggttcccgctcggcggacctgtccacccaggtggcccgggccctgctgggggtgaaaccggacgtggcggtggtgctgatcgggtcgaacgacgcgacgtcgggccgggcgccggaggaggcggccggccatctgggtcaggcggtccgccggctgcgcgccgccggcgtgcaggtcgtcgtcggcacctgccccgatctgggcgcgctgcggtcgatggcgcccccgctgcggcagatcgccggcgtgttcggccggcggatggcgaaagcgcaggccaaggcggtcgccgatgccggtggcgtggtggtcgacctggccggggagaccggcgcggtgttccgggccgatgccgggacgctgtgttacgacggcttccacccgtccgcggacggctatcgggtgtgggctcacgccctctatccggcggtggcgaaagccgccctgagcggcgtgtgatgatgtgaccaatccacacttccgaccatgttaccgctgagtaaactggtggcatgccggaagctgtcatcgtcgccactgcccgctccccgatcggccgcgcccacaagggctcgctgaaggagcttcgccccgacgacctcaccgccaccatcgtcgacgccgcgctcaacaaggtgccccaactcgatcgcgccctgatcgaggatctctacctgggctgtggcctgccgggtggcgagcagggcttcaacatggcccgggtggtcgccaccaagctgggcctggacggtctgccgggcgccaccatcacgcggtactgttcctcctcgctgcagaccacccggatggcgttccacgcgatcaaggccggcgagggcgacatcttcgtctcggccggtgtggagaccgtgtcccggttcgcccggggcagctccgacggcctgccctcggccgcgcaggcgctggtcggcggcggctgggagaacccggcgttcgccgacgcgcaggcccgcaccaaggccaccgcggagagcggcggcacctggcacgacccgcgtgaggacggcctgctgcccgacatctacatcgggatgggctacaccgcggaaaacctggcccagatcaagaacgtctcccgcgaggagatggacgagttcggtgtgcgctcgcagaacctggccgagaaggcgatcgccgacggtttctgggagcgggagatcaccccgatcaccctgccggacggcaccgtcgtgtcgaaggacgacggcccgcgcgccggcgtcaccctggaggcggtcagcggtctgaagccggtgttccgcccggacggccgggtcaccgccggcaactgctgcccgctgaacgacggcgccgccgcggtcgtcatcatgagcgacacgaaggcccgtgagctgggcatcaccccgctcgcccggatcatctcgaccggcgtcaccgccctctccccggagatcatgggcctgggccccgtcgaggcgtcgaagcaggccctccggcgcgccggcatgaccatcgacgacgtcgacctggtcgagatcaacgaggcgttcgccgcccaggtcatcccgtcctacaaggacctgaacatcccgctggacaagctgaacgtcaacggcggcgcgatcgcggtcggccacccgttcggcatgaccggcgcccgcatcaccggcaccctgatcaactcgctgaactggcacgacaagtcgatcggcctggaaaccatgtgcgtcggcggcggccagggcatggccctgctcatcgaacgcctgagctgacccggcagcggcccccgcacccgcggctcgacgcacccgcagagcccggcgcttcccgcgccgggctctgcccgttccggtcacatgttcccgccgggcccgcctcgttccgcgatccgattgccgcggtacgtcgtcagcccacgagccaccccgcgtcacagctctccggtgttgccgggcccacgtcgtcgttcggtgtgccgacgggccgcgggccggcccgggtaggctcgccggatgtccgacttcgccacgtcgatcgagcgtctgctcacccaggtccggcactgggaggagtcccgctggtccgcgcgcgccggcgcggagagcgcggcggggggcgactcggcgagcaaggccgatcaggcattcgcgctggtgcagcgtctcgccgatctggacgcggaggcggcgggccgggcgccgcgcgaggtgccacgactgcacgatctggtgctgccggatcagctgcgggtggtttccgacgatctgctggccgcctcccccggcccggaactgctgacgattgccaccgcggccgtcgacgaattccgtcgtatcgtctgacccctgcgcaccggaccggacattccatcatttcggaatgcgacggcacgattaccgcaggtgcctatcgcgggatcaatcgacccgtgcggcgctttcgacgtacaccagcggaatgggtcgtgccaccggaaaccgcgagcgaaagagcgcaccgggaggcgcgtggccgcacgcgggccatggtgggggaagaaggcagcgctagctagctagaggccgggcgctgatcgtcaagggcaacgcccggaccgcggggaggcggccgggcgttgcgggttgacggaccgacgaaccgtcagtcgtcgccctgcagatagctcagcaggcgcaggatctcgacgtagagccagaccaggccgaccaggatgccgaacgccgcggtccacgagtagcgcttgggcagaccctggcggacgccctcctcgatctcgttgaagttcaggatgaagctcagcgaggcgacgacgatgcagaccaggctgaagaggtagccgagcgggccgttgtcgcgcaggcccgtgttgacgccgaacaggtacagcaccaggttgatcagcatgaccatgaagaggccgccgagcaccgcatacatgatccgctggaacttgggggtggccctgatgacgcgggcgcgatagagcatcgccatcaggaagaagacgccgaaggtggcgaccaccgcctgcagcacgatgccgtcatagccgaggaagctctggtaggccttgctgatcatgccgacgaagacgccctcgaccaccgcgtaggccacgaccagcgccgggttcgccatccgcatgaagctgaggaccatgccgagcacgaagccgaccatggcggcgccgatccaggcgaccatggtcatcgagatcgggacgacgctccacgccacgaccgccgagataccggtgatgcccagcagggtgaccgtcttgacgaccacgtcgtcgatggtcatcggctggacggcgggcggggcggcgtagccctcggcggtcggatagggctgctgaccgtagccgtaacccggctgaccgtagccgtagccgggttgaccgtaacccgcgtgcccggccggcccgtacccggccgtccgctcccgctcggccgcctggccgaggcgcgagagcaccgggttggaagtcttcactgtgtccagcctcccttgaggttcggcaccaggatgcctgtggttcaagggtaagcgctgcgcctccggatcgccgctctgcgaagctgtgagcaggctgaaaatgacaagtgtcatgggtgcgtggcgcgctccgatgctagtcgacggcccagccaccgacgaagagacgacgggggaacgacgaagcggccgcgaccgaaccggtcgcgaccgctctgtgcccggggcgggtctcgaacccgcacgcctgttagggcagccgcttttaaggcggccgtgtctgccattccaccacccgggcgggcctgcgaacaccgtagctggtgccgcccgcccggtggggaacggccttgccgtcagcgagccccggaggccaccttctcctcggccttcggcttcggcgcgaccggtggggtcacctcgaggaactcctcgcgcggcgcgtgcagctggccgagtgccacggtctcccgcttgaggatgaaggccagcacccagtcggcgagcacccgcaccttgcggttgaacgacgggatccggctgacgtggtagaagcggtgcatcagccaggccgggtagcccttgaccttgatgccgtagacgtgcgcgacacccttgttgatgcccaggccggcgacgccgccgacgtgcttgtgccggtactccttcggagcgccgccgaggatcacctgggcgatgttgtcggcgagcaccttggcctgccggaccgcgtgctgggcgctcggcgagcaccagccacccgggttggtcaggtcggggacctgcgcgcagtcgccggccgcccaggcaccctcgagcacctcgccctcgagcgtggcgacctgcagggtgggcaggcagttgacgtgcccgcgcggaccgagcggcaggtcggtctgctgcagcatcggcgacggcttcacgccggccgtccagaccagggtctcggcgcggaacgagtcaccgtcggagagctcgatctggccgtcgacgcaggagttcaggaagacctcgaggcgcaggtcgacgccgcgggcggcgagctggcgagcggcgtacgcccccatctcggggccgacctcgggcagaatccggttggtcgcctcgaccaggatgaagtggacctccttcgggtccagctccgggtagtacttcaaaccgtcggcgaccaggtcctgcatctcggcgagcgcctcgatgccggcgaagccgccaccgacgaagacgaagttgagcgaggccttgcgcacctccgggtccggcgtcacggcggcgacgtcgagccggtcgaggatgtggttgcgcaggtagatggcctcgccgatggtcttgagaccgataccgatctcgctgagaccggggatcgggagagtccgcgagaccgagccgggcgccacgatgatgtggtcgtacgccatctcgtaggaggggccgtcgatcggctgaatgatcaccgtcttgcgagcgtgctcgaccttggtgacctcaccggagacgatgcggcacttcttcagctcacggcgcagcggcacaacggcgtggcgcggcgagatgctaccggccgctgcctcgggcaggaacggctgataggtcatgtgcggcacggggtcgatgacaacgacctcggcgtggttccggttcagcttcttggacaggcgtagggccgtgtacagcccgacatgacctgcacctacgacgactatgcgcggcggattcacgcccctattctcgcgcgcgaccggccgttcatgcgtcgttctgtgaccatcgcaaccttgaaagtcaagtgtcgaaggacacataaactccccgaatatcagctccgcctggtaaggcgaaccaaaagcatcgtcacaccggtcgcagcagccaatcccaccaatgtcgccaattggaacgcatcaccatcaagatccgcagtaagccccagagcgagcacggtcaacaccgccgagatcagcaccacgatcccggcgcggcccagccacaggcccgggacctccaggttgaccaccgcgtcgtagggcaggacggcggccagcgcggtcagcgtgtgaccgagatagagcagggtggccagggacagcacccgccagagcgcgatccgcgagtcgtaccccgaggtgtcgacgatccagccggccaccacgaccagcgcggcgaaggtggcggcgcggccccgcggggcgaacgccggccagagcgcgaccagcaccagcggcaccacgaactgactcgccaccagctcgatcggccaggccacggcgatcgcgaacagcccgcacagggcgatgccggcgcgtaccagcatcgggatcacggtggcccggcggaccatgcccgggatccggctgatccgccgcaggagtccggtcagcacgtcatcgccccctcggtgcggcggccatccgggccacgtcgcgcagcaccaggtccaggctgccggcgccggcccaggtgaccaccggcacaccgtgctcgcggagccggcccagcacgttttcccgctcgatccgccacagccgggtggccagctggctccactggttgcggaccggcggcgcggcgtcctccggcaacgtgtccaccgcgaccacgaaccggccggcctgggtgagctgggccagcatgtccgcggcgcgcggatcgatcagcggggtgagcaccacgaccagcgccgaggtggagatctggtgcgagccgagggcaggttcgtactcctcgtcgaccgggtcggcgcgcacgtcgagcagccactccaggacggtgaggtactgccggcggccggaggcggcgcgcagccggcgggcggtggcgccgtactccagcagtgacacccggtcgccgcggtgcaggtagtgctcggcgaccgcggcggccgcgcggaccgtggtgtccagcaccgaggcgccgcccgccaccccgccggaccggcccacctcgcccagcaggtcgagcaggagcagcacctcggcgtcgcggtccgagagggtggaggccacgtgcaggtcgcgggtgcgcagcgagacccgccagtcgatgcggcgcagccggtcgccgggtgcgaactggcgcacgccggccagctcaccgccctcccccagccgccgcgagcggtgcgcgccgaccaggccggccgcggccggcatcgcctcggtcgccttgaacggctcggtcatcggatagacccgcacgccgcgcgccggggtgaccaccggctagctagctagcgcggcccgcgcggcggccgggccgacgtcctgccggccccagcgcagcgcctcgccgggcaggtcgacggcggcccacccgtcggacggcacggtgatcgcgaacggccggtcggcgtgctccaggcgcagccacggcgacgtccgggtgcgcaccaccaccaggtcgtagccgagcacgtccgggttggccacggtcagggcggcctgcaccgcgccgccctcgaccaggtgcgcctcgtcggcggtgatggtcacctccggcatcgcctgcggccggttccgcaggttcagcgccaccccgatcgcgaacggggcggccagcagcaccaggtcgacccggcccagggccacgccgagcagcaggagcagcccggtgagcagcaccgagcggccgagcgcccgggtcggcgcccaactcggagcggccggttcagtcatgccgggcgtaggtcggaagcgccccgctggccggggccggcaccgcgctgagcacctcctgcaccacgaacgccgggttcacctggcgcagccacatctccggacgcagcgtgatccggtgcgccagggccggcaccgcgacgtccttgacgtcctcgggcaccacgtagtcccggccggccatcgcggcccgggcccgggccagcagcagcagtgccagcgagccacgcggcgacgagccgaccagcaccgcggtgtgctcgcgggtggccgcggccagcgagacgatgtagcgcccgatcgagtcctcgaccgcgaccgactccagcgcggcctgcatcacctgcagggtgcgggcgtcgaccaccggggtgagctgcgcctcctcctgacggcgggacatccggcggcgcatcacctcccactcctcctcggcggtcgggtagccgaacgacacccggagcaggaaccggtcgagctgcgcctcgggcagcgggtacgtgccctcgtactcgatcgggttggcggtggccagcacgtggaacggcgggtccagccggtaggtcacgccctcgaccgagacctgcttctcctgcatcgcctcgagcagggcggactgggtcttcggcggggtccggttgatctcgtcggccagcagcatgttggtgaacaccggcccggcccggaacgcgaagtcacccttgcgctggtcgtacaggaacgagccggtgacgtcggcgggcagcaggtcgggggtgaactgcagccgccggaagtcgagcccgagcgcctgcgcgaacgaccgcgcggtcagcgtcttgcccagcccgggcaggtcctcgagcagcacgtggccaccggccaggatgccggccagcaccagttcgagcgcctcccgtttgccgaccacgacgctgttcaccgcgtcgagcaccgcaccggccagccgcccgacctcgtacggaggaagagcctgtccgccttgctgggtcaccggcgcacctttctcacagtcgttccatggcttgcacgtacgtctccaggtctttcgccttcagtccgcgacgaccgggatcggacagtaccgcccaggcgtcgccgccgagcagttcccgggcgcgtgccggatcggtggcgcgggtgatgccgtgccgcagccgcaggcgttcgtcggcgagttcgccgagcaccggcagcacgacggtacgcgcataggtgtccgggtcggcgtgcgccttgtccagggtccactcccagcggcgcaccgtggcccgcagcgagtcggcggcccgggcctggcgtcggtgccgccggctagctagctagagcagcacgttgccggccacccgcagcgccggcgagcggcgacgggccggcgccggcgcgggctccggggcggccggcgcggccgtcatcccgaagagttcgtcgagtcccccgtcgctcacgccagcgcccccaggtcggcgcgcaaccgctccagcgcgtaccgcgcctgctggcgcatccggtcgtcgacggtgtgggtggcgtaccgggcctcccggtacacctccatcagggcggcgagcacggcggcgtccacctgttgctcggcgagcagccggccgaccaggtcggtggggctgtcgccgggatgccggacggtgccggccgcggcggcggcctgctccagccgcacccagcaggcgatcaccgcgcgacgcgggtcgcggtcggtgtcggagagctcctccagaccggcgtcgagcgcggcgaccagatcctcggcggtgttcccggcgcggcgcgggtcgcggcggccggtccggttgcgccgacggcgggccacgtcccgcagcagcgcccagatgaggatcaccaccatcacgatcaccagcacgacgatcaccgcgaccgccgcgctgccgacccagccgggcaggccgcgagccgcctcgaccggcgactcactctgctccacggtcggatgcggggtgggcggcagcagcggcgcctgggtggtcggcgtggtggactccggggtgatccggtccagctggggcgccgagcgggtggccgccagcgagatcacgaagagcagcccgatgacggcggccagcggccaccagcggcgcagaagtccaaggtccatgcgggcgcgatcagatccgtgacgtgaggcgacaaacagacctgcgcatcatgccaggcccgccagatccttcgcacgcgcgaacaccgcgtcgagcatgtcgggggtgagccggccggtgaaagtgttctgctggctgacgtggaaacaccccagcagcgggggcacgccgggcagatgcacctcggcgccgtggccgaacctcgggcgtggcacggggggtgtcaccgcgtacgccgatctcatcgccggccaccaggccgcccaggcgaaggcacccaacgtgaccaccaccttcagggtgggggtgagcagccgcaactcgcgctggaaccagggggcgcaggtgtcgcgttcggccggggtcggcttgttgtccggcggcgcgcagcgcaccgccgcgaagatccgggtgtgccgcaaggtcaggccgtcgtcggcggcgacgctggtcggctggttggccagaccggcccggtgcagggcggcgaagaggacgtcgccggaacggtcgccggtgaagatccggccggtgcggttgccgccgtgcgccgcgggtgccaggccgaggatgccgatcgcggcgtccgccgggccccacccgggcaccgggcgcccccagtagtgctggtcgcggaacgcggcgcgcttgaccgtggccacctcggtccgccaggcgaccagccgggggcaggcgaaacaatccgcgacgcgggcatcgagcacggtcagcgacgcggccccggccgcctgatcgacaaccgattgcggcgtacgcggtgagctctccgacggttgcacccgttcagcagagcatcccgcgccgggaacggcaccaccgggggcgacgacgccacccccggtgggctcggttcagcgacctcgggctcagccgttggccttgacgcacagcaggtacttgttcttggagtcggacgggctggacaggatcgccgggtccttgtccttctcggtgaagtacttgtcgcaggcggtgctgttcacgtcgttgacgccgtcgacccggccgaccacgatgaacttggcgtccgacttcgagcagtcgacgatgtcggccttggtctcggtctccttgtcggacagcttgtcgtcgaccgagatgcagttgccgaccttggcgtccttggtcgggtcgccgctgagcgccttgctcaccccgaagccgatgccgaacttgaccgccgcgatgacgatcaggaccacgatcgtgccgagaacacccagcagcttcttgccgaacgacttcttcggggccggctgcggggccgggaaggcggccgcgccgggcggcgggtaggcggactcgcccggggcaccggcgttcggcggcgggtacgcaccgggggcgccggcgttcgggggcgggtaggcagcgggggcgccggggttcggcggcgggtacgcaccgggagcgcccgcgttcggcggcgggaacgccgtgccgggctgctcggcgggcgcgccgtacgggttcggctcaaccgggttggacatcgatgcttcctttcgcggacgccaagcgtccgttcgctgtggcaggcgaggataaccagccgcggaagcctcacgcgaccccgcccacctgcggttatcggaaaacatcgaagaggtgctgagactttgctgggaatatcacgcagggtgccgtcatagcgacttacgggcggcgaaaagtagctgacagggcggatcggaccggccgttcagccgacggccgcccgccggcggcatcgttgcccgcggcctccggcgccgtcacacagccgtgcggccggcgtcagcccgccgccaggccgaacgcgatgccgtcgaggatgtcgtgttcggaggcgatcaccgtgtcatggccggaacgctccatgatggtccgcatgatcagcgcgccgccgccgatcacgtcggcccggcccggatgcatcaccggcagcgccagccgccgctccacggtcatcccgagcagttccccggtgacccgggtgaccgccgcccggctgaccgcactgtggtggatccgcgccgagtcgtactccggcaggtcgtgcgccagcgccgcgaccgtggccaccgtcccggccagcccgaccagggtgcgtgccgcccggccgccgaccgcggccagcgcggtgtccaccgccacggtgacctcccgctgcgccgcggccaactcctccgcggccggcggatcgccgtgcaggtgccgctcggtcatccggacgcagccgatgtccatcgagatggcgcgctcgacagtgtccgtgccggtgacgaactcggtggagccgccacccaggtcgacgacgagatacgggccgggcgcggcgagacccttgaccgcgccgaggaacgagagggtggcctcctcctccccggtgatcacctccgggtcgatgccgaggacaccacggaccatggcgcggaagtcgccggcgttcgacgcatcgcgcgaggcggaggtggcacacatgcgtaccgcgacggcctccgatttctcgatgtcggcggcgtagccggcgagggcgacccgggtccgctcgatcgcggcgggcgacagcatgcccgtccggtcgacgccctcgcccagccggacgatctccatccggcgggtcacgtcggtcagccggtcaccgtccacgtcggcgatcagcaggcggatcgcgttcgtcccgcagtcgatcgcggcgaccctcataggtgcagcagcattctcgtgttccccagggtgttcggcttgacccgctccaggtccaggaattcggcgacgccctcgtcgtacgaccgcagcagctgctcgtagaccgcgtgcggaaccggggccccgtcgatctcggtgaagccgaacgagccgaagaaccgggtctcgaaggtgaggcagaagacccgtcgcacgcccagctcgcgggcctggtcgagcagcacgccgacgatccggtgaccgattctccggccccgcttgtcggggtgcacggcgaccgtgcggatctcggccaggtcctcccacatcacgtgcagggcgccgcagccggacaccgtgccgtcctcgtcgaccgccacccagaactcctggacggactcgtagagggtgaccgtcgccttgctgagcagccgccgatccgtcgtgtacgtgtcgaccaggtgccggatcgcccggacatccccggtgcgggcccggcggatcagcattcgtcgcgcttgacgcaggggccgtcgacccaccacggctcgaccgcgtcgcgcacctcgtcgccgaacgggttcactccgcggcccgcggcaagcgcgtgtcccaggtggacgtgcaggcacttcacccggtcgggcatgccgccggccgacacgccgtggatctccgggacgtcgtcgatcgcctggcggcggtccagatagtcacggtgcgccgcggcgtagtgggcggccagctccgggtcggtgctcagccgctcctgcatgtcacgcatcacgccggccgactccagacgggagcaggcggccgtggcgtgcgggcaggtcaggtagtacatggtggggaacggcgtgccgtcgtccagccggggcgaggtctccaccacgtccgggttgccgcacgggcagcggtgcgcgaccgcgcgggtgccgcggggtgggcggcccagctgggccgccacgatgtcgaggtcggcgggggttggtgcatccatcagttcgcgggctccgcgtcggcggctcggacgctgttccacagcgtgtcgtaccagcggtccggggcggccgccggggctttctgaccggcgtcgtgcgcggcgccggcccggtcctcgatcacgagcagcggtgcctcacccgggcgcacgtaatacagctgcttgcgcgcctggatccggatgtactcgttgtcgttccacttcgccagctccgtcgccgtggcggcgatctggtcgcgctgctcggcctgggcccgctccatctgggcgatctgcgcctcctgctgcagatagacccggatcgggtaggtgtaggccagggccagcaccacgaggaccgcgagcaggacggttgcccggctggtcagcgcacgcggccggggcgcggcggtgcgcgtggcggccgggccgccggactgcgaagtacgccgcgcgccggccgggcgcgcgctgcgtgacgtgggcacccggacggtcgggcgggcctccacccggaccggaccggcgccacgggtgcgggaagcaccgggacggccactggcgccacccgatcggcgggacgggccctgaccgctcggcatgcggcgctgtgtcatcttcacccctccccgccccggattgtggcaccctcccgcggtcgggtgccaccacccatgatctgtcgagcgtgagttacgcgacccggtaacgcgggaacgcgcccgcaccggcgtaccgcgcggcgctctccagctgctcctcgatgcgcaggagctggttgtacttcgccacccggtcggaccgggccggcgcgccggtcttgatctgaccggagccgaccgcgaccgccaggtcggcgatcgtggtgtcctcggtctcaccggagcggtgcgacatcatcgtcttgaaaccggcccggtgcgccaggtccacggcgtccagcgtctcggtcagcgaaccgatctggttcaccttgaccagcaccgcgttaccggccgactcggcgatgccgcgggcgatgcgctgcgggttggtgacgaacaggtcgtcgccgacgatctggatcttgttgccgagctgctcgctcatcgcgctccagccggcccagtcgtcctcggccagcggatcctcgatggagacgatcgggtagtcggcggcgagcttcgcgtagtaggcgatcatctcgtcggtcgacttcggcgagccctcgaaaacgtaggacccgtccttgtagaactcggtggccgcgacgtccatggccagcacgatgtcgctgcccagggagaaaccggcggcctggaccgcctcggcgatcaggtccagcgcggcggcgttggccggcaggttcggcgcgaagccaccctcgtcacccaggccggtggacaggcccttcttcttcagcaccgacttcagcgcgtggtacacctcggcgccggtgcgcagcgcctcacggaaggtgggggcgccgatcggggcgatcatgaactcctgcacgtcgacgttggagtcggcgtgcgcgccaccgttcacgatgttcatcatcgggaccggcaggacggcggcgttcgggccaccgatgtaacggaacagcgggagctcggcggagagcgcggcggccttggccaccgccagcgagacgcccaggatcgcgttggcgcccagctccgacttggtgtcggtgccgtccaggtcgagcatcttctggtcgatcaggcgctgctcgctcgcctcgtaaccgatcagctcgtcggcgatcttgtcctcgatgttggcgaccgccttctcgacacccttgccgaggtaccggcccttgtcgccgtcccgcagctcgagcgcctcgaacgcgccggtggaggcgccggacggaaccgccgcgcggccgaccgtgccgtcgtccagaccgacctcgacctcgacggtcgggttgccccgggaatccaggatctcgcgggcgacgatcgcttcaatggtggccatttgtggtgtcgctccctaagcgttgtacgaataccgtttcggtccgcgaccctgcgggccgaccacgcccctgagcgtatcgagcccgcccgccgcacgttcgcccggccggtcaacttcaccggccggtatgcctcaaaacctcggtccgcctgccgaaacaggggacactatgagcatcagcgtgtttccagaggacggctcacgcgtcgagatggagtccgggggcgacatccacccgggcgtccgggtcgtggccgggtcggcggccggggtgaccgtctccctgccgcaggccggggtgccccgggccggcgcgaccgtgatcctgcgctggccggccacgccccgcggccggtacgtggtgtccgccacggtcgccgcggccggtgagaaccgggtggaactccgcctggccggcgagccggagatcgtgcagaaccggctctacgtgcgcggcggcggcggtgagccggtggtgatgacccggcccgggcaccccgacgcgatcggctgggtgcacgacatcagcgaacgctcgatccgggcgcacttcaccgacgtggaggtgcggcccgggcacgaggtggcgctgcgcgtccaactcggcgccgacgtggtggagatgcccgccacggtgtggaaggccagcgcgatgcggcagcaggtgccggtccgcgggccgctgtcggtggagatggtcgccctctacgacccgcccgagtcacaggcgaagatcattcggcgttatgtcctgcgtcaccagctgttgatgcgcgcgaaaaccgccgagtcggcctgaacaatcgttcatcggacaattgtcaaaagcgtcgatcaattgatcggcggatatcatttgcatgtcgcggccgggtgggccagggtggtgatcgtggcccgccgtcgttttgtgaatggaatactggccgtgggcgtgctgctcgccggcaccgcctgcaccgacctcgaccaggccagcgccgccggggtcggccccgccgacgcggtcgcccagctcgccgcccagctcgccgactcggccgacgcgacgtacaccgcgacctacagcctgaccggcggcgacaccgccacggtgagccgggcgcaggatccgccacggaccgcgtaccgctggcccggcggccggctcatcctcaccgcaaccgggaccacccggtgtgcgaaggcgacctgcgcgatcagcgaccccggcgggccggccccggagccgccgcccgccgccggtctcatcagcccggaaggggtgatggcgatgctgcgctccgccgaggcggacccggccctgcggatcacccagcgggacaccaccctggccgagcggcacgcatcctgcctgcagatcgtcggctcgttcgaggtgtgcgtggccggcgacgggacgctggccgccttcaagggcaacctcggcggcctccgcgtcgagatgaccctcaccgacctcacctcgaccaccgccgtcgccgacttccggcccccgcccggcgccaccgtcaccgaccaacgcccgaagtaaccccgcgctccgcagacgcccaccgccccgcaaccgtgtgccgagatcagcccccgcgcgccgaccgggaacccgcaccgccccgcaaccgcatccggcggatcggccctcgcatgcccaccgcgaacccgcaccgccccgcaaccgcattcggcggatcggccctcgcatgcccaccgcgaacccgcaccgccccgcaaccgcgccccaggatcacccccgtgccacccatcggggccggccccgcggcgggcacccctacaccccgagcaacgcccgcagatgccgcggcggcggcgacccgtgcgccagcatcgcgtcatgccacgccttgggcgtggccccgaacggccgcaacgccgccagccccgccacctcggtgtatcccacgaagtaggtggacagctgggtcgaggtgagcagcgcccgccgccatttcccggccgcctccccctcctcctggaagccccgcccggtcatcagcgccatcgcctcgccctcggccaggtcctcgcagtgcaccagctggtcgatgatcgcgttgagactcatccgcagctgcatcttgagctgctgcagtttcaccgcgggcccgccgaagccgagcccgaccatcatctcctcggcgtagaccgcccagccctcgacgaacggtccggaccagccgagcgcccgcaccgggctgctgccccggaaccgccgcgcgtgcgccaactgcaggaagtgccccggcatcgcctcgtggacggtcaggttgcggatcatctcgttgttgtattcgcggtagaagctgcggatccgctcgggcgaccacccggccggcgcgggcgcgatgcagtagaacgtgggcacgtccgcggtctccagcgggccgggcgggtcgcagtaggccaccgccacgccgcgggcgaactccggcatctcctcgatcacgcacgggtcgtccaccagcgacaccacgtcgtgggcgcggacgaactcggtggcctcgtccatcgtgctcttggccagcccgaggatggtggtgttgtcggggtgctgatcggcgatggtgtccagtgcgcgccgcacggtgtcgtcggtgggctcgccgccgaccatctcggccgccagcacgcgcagctcggcgccgacccgatcgagattggcccgggcccgggacagcacctcggccgcggacagctcggtgtcgagggtgtgccagagccgggcctcccacagccggcggccgagccgcgggtcacgccccgactcgccgctctccagccgcttgcgcagccagccgtcgaactcggtgagcgcggcgaccgcggccgcggcgaccggctccacggtgccccgcaggccgggctcctgggcgagcagggcgggcagctcgtcgcggatcagcccggcggtgccggcgaactggccggccgcggtctcggcgtggatccgcggcacgtcgtcgagcacggcccgggcggtggccagcgcgtcgggcagcgcggcgagccggccgcgcaggctggtcagccgctcggcgggcggcgcgaacgggcgggacagcaggccgtgcaggagcgggccggggttgtgctccaacgggttccactcgtgctcgcggacctcggtgagctcgaacagcccacggtccacctgggcggtgaggatcgcgtggtcgacctgctcctccgggtcgagggcgtcggcgtcgatcgcgctgagcgcgtcggccgcgtcccgcagcatggcgacccggccgtcgaccgcggtggcggagaggtcgggcagacggtcgtcgaaccgatggtcccccgcgtagagggccgtcacgggatcgctctccaggagagagtcggcgatccgctcggcaagtggcacaaactccggcatgccgaaaaacctactcggggggtccgactttttctgccgctcgcaccgcttcggcgtacgtcaaaacagccgcgcgcagctccgcctccgggtcgtgcccggccgcgcgggcctcggcgaccagccgcagcagcccggcgcccagctcgtcaccggccggcagcggcacgtccaccccgccccgggcggcccgctgcagcaccttcgcggccagcgccagggccggctgactcagcgccacaccgtccagcacggactcgcgcgccttctcctcgcgcttgatccgctcccagttggcggtgatctcctcgaggtcctcgacggtctccccggcgaagacgtgcgggttgcgccggaccatcttctccaccaggatcccggccacgtcgtcgatgttccacgcgcgcccgtccggcaggtcctcggcgagccgggcgtgcagcaccacctgcagcagcacgtcgcccagctcctcgcgcagctcgtggtaatcctcgcgctcgatcgcgtcgtacgcctcgtagctctcctccagcaggtacggcgcgagcgtccggtgggtctgcgcccgtttccacgggtcgccgccgggcgaggccaaccggtccatcaccgtgaccgcgtcgagcaggcgggcgccgggcgggtcccacgagccgtacatcagctccagctcggccaacccgggctcgcgcgccagccgcaggccgagctgtcgggcgaacggctggtcgccgtgcggcccggcgagccagaccgcgagcggggccgcgccgatcgcgtcgagcagcccctgcgcgtcgatgtccagcacggtgaccggcaccccggccgcccgcagcgcctcggcctgcggcgactcggcggcggcgaagaccgggccggagcggacggtgtcccaggcctcggcggtcagcagcccggccggcagccgcggcgaggtgaccagcagaacgatgcgggcgctcaagagacgtcggagaccgggaggtgcgccgggtcgccgagcggggcgccgaccatgccgatgttagtcgtctgggacggctggaaggtgtacgtcaccagctccagcggctgataccgcgggttgatcgtgacgtgcagcggcgcggccacctcggcgagctcgttgcgcaggccgatgccggcctgcaccccggccttgaggtccgcgttgctcagcaccgagcggaactgctccaggctggtgcccggcgggagcgccttctgcacctcgggacgctggtagacatcgcgcagatcgtcgtcgctcagcgtggccgggccggtgatcttctgactcaccgcctgctgcagggtgccgttgtcgacgatgaggtgcaggagctcgttgtccgccggcagcccgatcagcttggcgtactggtcgtacggcaggttggccggcagggtcacctggtggcgggccgcgagctgatccagcaacggccgggcgaccagcagccggacgacctcggaccgcggaatcggcgtggcgcccgcaccggcccgggcccgctgcgcctcgtccgcgatccgctcgacctgcttctcggtgatccgggtgtccccgacataggcggccacggacggctcggagcggcacgcggacaggccggcgaccgccagggacgcgatgacggccatggatgcgaatcgtcgggtacgcagcatggtcaacactgtctcacgcgaaatgtgatccgtcacacccgggccggggccggcgcgtcaccgagcacgtccttgagcagctgggcacaccactggagcagatcctggtcgcgcagcggctcgccgccgacccgccgggtctgcggccgcggcacgctgacctggtcgttcgccggcttgtagaccgagtccgggtggtaccgcttgagccgcatctgcttggaatcgggcagcgcgagcggggcgaaccgcaggtgcctaccctgcatcgacacgtcggtcaggccgtacgcccgggcgagctggcggaaccgggccaccgcgatcaggttgaccaccgcggcgggcggctcgccgtaccggtcggtcatctcggcgacgacctcgtccagccgggcgtcgtcgcgggcctcggcgagtttccggtacatctccaggcgcagccgctcgaccgcgatgtagtcggtgggcaggtgcgcgtcgatcggcaggtcgatcttgacctcgggctcctcctcgggccgctcgcccttgaacgcgctgaccgcctcgccgaccatccgcacgtacaggtcgaagccgacgccctcgatgtggccggactgctcgccgccgagcaggttgccggcgccgcggatctccaggtccttcatcgcgacgtacatgccggcgccgagctcggtgtgctgggcgatggtggccagccgctcgtgggcgtgctcggtgagcggcttctcccgggggtagaggaagtacgcgtacgcccgctcccgcccgcggccgacccggccgcggatctggtgcagctgggccaggccgagcaggtcggcgcgctccaggatcagggtgttggcgttcgggatgtcgatgccggactcgacgatcgtggtgcagaccaggacgtcgaactccttctcccagaagccgaccatgaccttttccagctgctcctcgctcatctggccgtgcgccaccgcgacccgcgcctcgggcaccagctcgcgcagccggcgggccgcccggtcgatcgactcgacccggttgtgcaggtagaacacctggccgtcgcggagcagctcgcggtggatggcggcggcgacctgcttgtcgtcgtacgccccgacgtaggtgagcaccgggtgccgctcctccggcggggtggcgatggtggacatctcccggatgccggtgatcgccatctccagggtgcgcgggatcggggtggccgacatggtcagtacgtccaccgacgcgcgcagcgccttgagctgctccttgtgctcgacgccgaagcgctgctcctcgtcgacgatgatcaggcccagattcttgaaccgggtcgacttggacagcagccggtgcgtgccgatcacgatgtcggcggtgccgtccgcggcgttctccagggtgagtgccgcctccttgggcgtctggaaccgggacagctgcctgatctgcaccgggaactggctcatccgctcggtgaacgtgttgtagtgctgctgggcgagcagcgtggtgggcaccagcacggccacctgcttgccgtcctggaccgccttgaacgcggcgcgcaccgcgatctcggtcttgccgtagccgacgtcgccgcagatcagcctgtccatcggcgtctgcaactccatgtcgtgcttgacctcgatgatcgcggccatctggtcgggcgtctcggtgtacgggaaggcgtcctccaactcgcgctgccacggcgtgtccgggccgaaggagtggcccttggaggcctgccgcgccgcgtacaactggatcagctgggcggcgatctccttgaccgccttcttggcgcgggccttgctcttctgccagtcggcgccgcccatcttgtgcagcgtgggctgctcaccgccgacgtagcgggacagctggtccagctggtcggtggggacgtagagccggtcgccgggctggccgcgcttggacgcggcgtactcgatcacgaggtactcccggtcggcgccgttgaccgtgcgctggaccagctcgatgtagcggccgatgccgtgctgctcgtgcaccacgaagtcgcccatcttgagttccagcgggtcgatcgtgttgcgccggcgggccggcatcttgcgcatgtccttggtggaggcgccgcgcccgccggagatgtcgttgccggtgatcaccgcgagccgggacgcctcgtcgacgaagccgtggttcagcccgccgcaggtgaccagcagctggccgtcggcgatcggggtggcgatcgagtcgaccggggtgaccccgaggcccgcgtcccggagcagctcggtggcccgctgggcggtccccttgccctcgaagaccagcgcgaccgcccagcccgcggcggaccagccggccaggtcggcggccagccgctcggtgtcgccgtggtagagcgggaccggctgagcggccagcgccaccgcgtcaccggtgtccggcgagacctcgaccgtcccggcgtcctcccacgggagcgcggcggccggctcgtcggcggtggccaggccgaacggcgagagcgtccaccacggctggtgcaggacggcggcgtgggcccgcacgtcggcgagggtcttgaaggcgaccgcacccacgtcgatcggcgcctcaccgccgaccgcggccgcggcccaggaggcctccaggaactcgtcggaggtgcgggtgaggtcgtgtgcccgggtgcggatccgctccgggtcgcagagcagcacgtgggtgccggccggcatgcagtcgatcagcagctccatgctgtcggtgccgtccagcagcgccggcgccagcgactccatgccctcgaccgggatgccctcggccagccggtcgagaatctcggcgagctccgggtgccgggtggcgagcagcgccgccttctcccggaccgcgggggtgagcagcaactcccggcagggcggcgcccacagccgctcgacctgctcgatggtgcgctggtcggcgaccgcgaaggtacggatctcctccacctcgtcgccccagaactcgacccgggacggatgctcgtcggtcggcgggaagacgtccaggatgccgccgcggaccgcgaactcgccgcgcttggtcaccaggtcgacccgggcgtacgccatgtcggagagccgccgcgcgaccccctccagctccgcctcccgcccggtgaccagctccaccggctccaggtcgccgaggcccttgagctgcggctgcagcagcgagcggaccggcgccacgaccacctgcagcggctggtcaccggggtgggccaggcggcgcagcacggccagccgccggccgaccgtgtcggaccggggcgacagccgctcgtgcggcagcgtctcccacgacgggtagaccgccacccggcccggctcgatcaggcagcccagcgcgtcggccaggtcgtcggcctcgcgcgaggtggcggtgaccgcgagcaccggccgctgcgccccgccggcgtcggccggaccggccacggtggccaccacgaacggccgcagcgagaccggcgcggtcagatccatcgagtccgagtcgacgaagcccttacgggccaggtcacgggcccgggcgaggccgcggtcgcgcagggcggccgggatgagtccggcgagttgcatgacgagaaaccccccgagggcacgacgaaccaccccggacgccccaacgggggcggggtgatgcgaacagcttagtccgacccaccgacactcccggcggcacgcgtggtatcgcacagcacgtccgacgtaccgccgccggccggtgcacagacttcagccgggacaggttaggggaggcaccgtgcgcatcctgctgctagtcagcgctttcaacggcttgagtcagcgggtctggtgcgcgttgcgcgacgccggacaccaggtgggtgtgctgctggcgggcagtgagcagcagatcgccgacggggtccgggccgccgacccggagctgatcctctgcccgttcctcaaggaccgggtccccgccgaggtgtggcagcgccggcccacggtgatcctgcatcccggcccggtcggcgaccgcggcccctcctcgctggactgggcgatcagcgagggggcccgcacctggggcgtgaccgcgctgcaggcggtcgaggagctggacgccggaccgatctgggcgagccgcaccttcgacgtgccggccgccccgccgcgcaagtcggcgctctacaccgggccggtctcggacgccgccctggagtgcgcgctcgaggtggtgacgaaagcggccgacccgtcgttcagcccggtcccggcatccgtcgcggctccccggccgatgatgcggcagagcgaccggtcgttcgactggggcgacgccaccgacgcgatcctgcgccggatccgggccgcggacggctcgccgggggtgttgaccgaggtgggcgggctacccgcgtacgcctatgacgcccatcgcggagcggcccgcggcgcccggccgggagccctgctcagccgccgtcaaggggcggtgctcgtcgccaccggcgacggcagcctgtggatcggccacctgcgaccggccggccccggcgggatcaaggtgccggccaccacggcgctcggcgagcggctgcgcggcgtgccgaactcgccgctggaggcgcacgcccagccggaggcgccggccgcctaccggcaggtccgctaccgacgcaccggggcgatcggctggctgcacttcgacttctacaacggcgcgatggcgcccgggcactgccgccggctgctcgccgcgctgcgacacgcggccgcccaggacacccgggtgctggtgctgcgcggcgggaccgaggcgttcagcaacggcatccacctcaacgtgatcgaggccgcacccgacccggcggccgccgcctgggccaacatccgggcgatcaaccaggtgtgccgggagatcatcgggtgcacccggcagctggtggtggccgcctacgcgggcagcgcgggggccggcggggtgatgctcggcctgggcgccgacgtggtcgcggcccgcgacgggatcgtgctcaacccgtactacgacatcggtctgtacggctcggaactgcacacctacacgctgccccggcgggtcggcgcggaccgggcgcagcggctgatcgacgagaagctgccgctcagcacggcgcaggcggtccggatcgggctcatcgacgaggtcggcccgcgccacccggaggcgtactcgcagtggctgaccctgctcgccgaacgccactcggacgcccgcagcgcccggaaacgccgggccgccaaagcacgccggctggccggggagcgcatcccgctcgacgtgtacgagacccgcgagctggccgagatgagccgggacatctacaccgaccggtccggcttcgccgccgcccggcaggcgttcgtgcgcaaggcccggccggacggcacgccgcgccggcctagctagctagtgctgctcgccggcaacgccggaccggccctgcccgggcgccagcggaccggcaacagcggcccggccggcgagcggcgggcgccgatcacggtgcgcccggcggtgccggtctcggcctgaccgccgcaggtcgggccgacggtggccgcctgaacgaccgtgagactcttgactcaattcacccccgcgccgggggacgccgatacgatcggcgaagtcgggacagcgccgtcctggagccatccgagcgaaggagcgccccgatgacagagctgcccgcccatctcgacgagcgagaggggcccgacgccgagctccgtgccgacatccgccggatcggcaccctgctcgggcagaccctggcccgccaggaaggccggccgctgctcgacctggtcgaggagatccgcgccctggtccgccaggacgtgccggccgccgccgagcggctcgccgcgatggacatcaccaccggcaccaagctggcccgggccttctccacctacttccacctggccaacatcaccgaacaggtgcaccgcgcccgcgacctgcggcgccgccgggccaaggacggcggctggctggaccaggccgccaagcggatcgccgagcggggcgtcccggccgacgagatcgcctcggccgcccgccggctcgcggtccgcccggtcttcaccgcccacccgaccgaggcgtcgcgccggtcgatcctgtcgaagctgcgccaggtcgccgactcgctggacgccgagtcggccgccgccgcgctctacggcgacaccgacaccacgcagtccaccaagcggttcgccgagctgatcgacctgctctggcagaccgacgagctgcgtctcgaccggccggacccgaccgacgaggcccgcaacgcggtctactacctcaaggacctgtacgccgaggctgccccgcaggtcctcgacgacctggccgagacgctgcgccggctgggtgtggagaccgcgcccacgtcccgcccgctgaccttcggctcgtggatcggcggcgaccgcgacggcaacccgttcgtcacccccgcggtcaccgccgccgtgctgctcatccagcacgagcacggcattcaggccaccgagaaggtgatggacaagctgatcgaggagctgtccgtctcccgccggctgcgcggggtctccctcgacctgtccgccagcctcgcccaggacctggacaacctgcccgaggtcgccgaccggttccgccgggtcaacgccgaggagccgtaccggctcaaggtccgggcgatcaaggcgaagctggccaacacccggtcccggctgcagcacggcaccccgcacgtggccggccgcgattacctgggcagcgacgagctgatcgccgacctggaactgatgcgcgcctcgctggcccgcaactccggccagctgcccgcggtcggcgtggtcgccaccgcgatccgccaggcgtccgcgttcggcctgcagctggccaccctcgacgtgcgcgagcacgccgagaagcaccacgaggtgctccagcagatgtacacgcaggtcggcgaggtcgaggactacgccgccctggaccgcaccgagcgcaccaagctgctcgccgccgaactgaccgggcgccggccgctgtccagcgccgacaccccgctgaccgactcggcgcgcaagaccttcgacgtgttcaacacgatccgcgagtcgcaggagcggttcggggcggacgtcatcgagacgtacatcatctcgatgacgctgggcgtcgacgacgtgctcgccgcggccgtgctggcccgcgaggccggcctggtcgacatccacaccggccgggcccgggtcaacatcgtgccgctgctggagaccccggccgaactggacgccggcggcgacctgctcgacgagatgctgtcgctgcccgcctaccgggcgatcgtccgggcccgcggcgacgtgcaggaggtcatgctcggctactcggactccaacaaggaggccgggatcaccaccagccagtggcgcatccacaaggcgcagcgctcgctgcgtgacgtggccgcccggcacggcgtccggctgcgcctgttccacggccgcggcggcaccgtcggccgcggcggcggccccacccacgaggcgatcctggcccagccgtacggcaccctcgacggcgcgatcaaggtcaccgagcagggtgaggtgatctccgacaagtacaccgtgcccgccctggcccgggagaacctggagctcaccacggccgccgtgctgcaggccaccctgctgcacaccacgctgtcggtcgacccggtccgcctcgaggtgtgggacgcgaccatggacaccacctcggaagcggcgttcgccgcctaccgccggctggtggagaacccggacctgcccgcctacttctgggcggccacccccaccgaactgctcggcgcgctcaacatcggctcccgccccgcgaaacgccccaacgccgacgccggcctgggcggcctgcgcgccatcccgtgggtgttcggctggacccagacccggcagatcgtccccggctggttcggcgtcggcaccggcctggccgccgcccgcaaggccggcctcggcgacgtgctcaccgagatgcacgacaactggcagttcttccgcaccttcctgtcgaacgtcgcgatgatgctggccaagaccgacctgtcgatcgcccgccgctacgtcgagacactcgtcccggaggaactgcacccgatcttcgccaccatcgaagccgaatacgaccgcaccgtccaggaggtcctcgccatcaccggcgagccccgcatcctggcggcgcagccggaactctcccgcaccctcggcgtccgcgacacgtacctggagccgctgcaccacctccaggtcgccctgctccgccagtaccgcgacctgagcgacgcggcccgccagatgccgaccgcgccgggcgcccgccgcggcccgtcggactcgacggcgttggaacgcgccctgctcaccacggtcaacggcatcgccgccggcatgcgcaacaccggctgattgtcgaccgcaacggcccgggagcgcgctcccgagccgttgcggtcgcttttccgtgcggcgcaatcaggcacttttgtttggttgcttttgtcacggctcggaactcgggtcaaagtcttttttacgcaggtccagcggggtacagatcgcatgctcccgcgcgggccgggccacggtgatctggccgctgcgcgtccacaacgatcaccgcggcccttcactgcccgccggtggtcccggagatcaaaaacaacggggcgccagctcgccatccgatccccgccgcccaacccagcacacccggtccgtgaccgcggcacccgcaacgacaccctggcctgaaaccgcagcagcggcaacgacaccctgctcccgcccgaacggctccagcgaaccccagacgcctcaaaccgcctatagccacccagaccaggcgaaccaggtggctacgttcgcgagtttggggctctgacgcaagaagcgtgattgatcttgagtggctgcatctcagcggcgatccgtgatggctgcctcgaggcgcaggccgacgccgacggttaccagcatcccggcgaagacgtagcccttagctggcgtgctgtcggtcgcaaggccaacgatagtgatcaagaagccagtgaccagggcaatggtcccgaggatccgggcagtgtcgactcgtcgttctcgcacatccatagacggcaccgtacgggtgcgaccagtgtgtcctttgccattgaggtgtgtccgcgtgtcaacggactctgtctcggaagaggtttgtgccactcaagtttgtctgcagcgacgcgactcccagggtggttcatatcgcgtgaggtactcgcgagcgcacggcagcggtcctgccagtactgaagcgttgtcacgggcccgtacgctcgaagccggatcattatggccgggtattttcctcgcgggtgttgtccgcccagccgagcaccccgatggccccacacttcgccgcgactgccgtcgcctcgtcgagcagtcgctcggcttcgtctgaacgaccgtcccgataggccaggtccgccagcgctaccagcccggccgctacccccgccgggaaatcgagctcccggcggagcgctaccgactcctccaacaggaggcgtgccgtggcgtgatccccggccatgcccgccgcgaagcccaggtgccgcaccgcgtaggacagtgtcagccgattgtcggtcgcccgggccagggctgcagagcgctgcaggtgcgggtgcgccgcatccccgtcctggcgcacaacctggaggaaacaacccagccagaactccgcctcggccagcgcgtggtcgtcgccgagcgaggcgtatagctcggcggcccgctcgaaggcgaccaactcgcgcgggtcctcccggcggtcacggaggaacgccgcgtgcagaacccggccccgcgccaacgccagggcagcttcgaggctgtctaactgctcggtcgcggccggtaccgcgtcaggatcgccgttgaaggtggcggcgtggaaaagctcagctgctcgttggagtctgggatcttgcgacattgccccaagctagcgcgagctcgcgcggccgtggcgcccgtcgatgcatgcagcaggcccgctgggtcgcgccggaggctggacgtgcaggtagcggcagtcgtcctcggtcaacgggaatctaaacgggcaccgggtggcgctacatcgcgacgttaacggccggcgaccggcagacaaacatgactggcaaaaccctcggcgggacaacttcgctggcacgcggacacacttcgttggcaaaggacacagtgagcggcgcatcgggacttatcgatcacacttcttgcgccagaagcgagtttgggaaccagatgttcccgacttccggcgccgctctgccaggatcgcgtgccggaatgttggtgagaaccggcgccactagcggatcttgaccatcgagggtgtcgacggtcatccgccacgcccgctcaccctgcgtaccaacgattacgaggctactcagagcgcgacgcgcggatccggctcctcccggtgtcatccaagacgtgggtctgtatcgagtaacagacccggcgaagggccggactcatctccgatcgcgtcagcaacgtgtctcttccgattcagcgctgaagctcgaggaggccgacgatgtacttgccggtgccggtgccctcggcgagggcttgctgcgcattcgcggcggcttccaggccgtgcagcacggtgacttctgtgctggcctgtcccgcggtgaggaggtcgagcgcgacgcgcagcgcagaggtgaccatgtgcggcgcccgggcggacagtgcggcgaggctgaagccaccgatggaggcattgcgcgcgtagagcgaagcggtagccggtagcgcacccagttgtgcgccggaggcgttgccgaacaggatgattcggccgctaggggcgagcagttcgagatcctgatccaggaaggcggtgccctgagggtccagcacgacgtcgacgcctcgatcgctgagttcggcgtggacctgggccgcgaaggtgtcgccgcgcacgagtacgtcgggatagcccgcgcgatgcgcggcctcgatccgggaaggtgcgccgacgacgccgatcaggcgcgcaccgctggttgcacgtacgacgtcggcgaaggcgcggccgatcgcgccggcggcgctgtgcaccagtacgacgtcagcggcgcggactctcgccaggtggtcgtgaagaagcactgcggtggtcagcaccccgggtgcgatgaccgcatcagcgaggttcagcccggcgggaacggatgcagtcaacgcggcatcagccgttgcgacttccgcgaggccgccctcattggtcagcgcgacgacccggtctcccaggcgtggacatgtgacgccgggtccgagctcgacacggttccggagacttcgaggcccggggtgaacggccacctcggcgcataccccgggtcgccgcgccgggccatgacgtccttgaaattgattccggcgaaggcgacctcgatggacacctgcccccggccgggcgtcgggcggtcgatgttcgctacccgggtcgcgctggtgtcgggagctgggcggtcgaacacgagagcttgcacggctaccatctctttcgaaggtcgtcgaaagttacgaccagagcctaccttcgatgactgtcgaaagagaagtcatgcccgtcacgccgcgccccccactggtccaccccgacatcgacgacgtagaactggtcgctgtgctgcacgcgctggccgatccaacccggctcacgatcgtgcggacgttgcgtggcgaacgggaacgcgcctgcggcacattccccgttcgcgtcgcgccctcgacgctgagccaccacttccgagtgctgcgggaagccggcgtcatccgccagcgtgaggacggcaaccgccgttgggcgatgctgcgcttggccgagctcgacgcccgtttccccagcctgatcgacatcgtgctcgcatcggccaccagaggctgaccagccttcagaccatccgttcatgtcgcagacagggcgtgccttggctccgatgcccgtcactgtacgtatgcggtatacccggccatcgacacgtgaccgggtccaaccgagaggtggggccccaactcgcgaacatcgcaatgggtgaaatctcggtggcgccgaacctcagcgacactcggcgccgagactcgcggacaaaaccaaccaggcaacccatggtccggaccctgtccatccccaccgacaagaaggccacgctcggtcggctctcccggcgtccggctctgtccgcgagccgccgctctacgccattcctcggcaggccggcgaggcaggctgagggtggggagggcatgagcgcgggggcttgattttgatgtccggaaccgaccgcggacagtgaagggccgcggtgatcgttatggacgcgcagcggccagatcaccgtggcccggcccgcgcgggagcatgcgatctgtaccccggcggatgcgcgtatatcaagaatttgatcaagaagttcgaccgcaaccgaaagcggcccggaagcgaaaacgcccgggccgcttctgctgaagatcagctggtttcgccggcgaggctgaaggagccgaggcggttgatggccaggaccgtgcagaccaccacgaagatcgcgctcatcaccgcggccgtggtgacgctgaccttcgggtcgaggaacgtggcgggctgcatcttgtgggcgatggtgatgacgtactgctggatggacagcacccgggtgccgctgaggaatttgccgagcaggttttcccagatcaggatgtagaccaggccgagcagcaccgggcggcgggtgagcaggctgagcagcaggaacagcgcggtgtaggcgaaggagccgactaccgcggcgagggccagggcggcgcccagtttggcggagttggccagcaggccggtgaggtacagcgggatcgccgacgtcacggcggtggcgagcaccgcgacgacgaacttggcgaggatgatctcgcggcgggccaggggcttggtcaggatgtggaccagggtgccgtcgtcgacctcggagccgaggacgccggtgccgacgatcagggcgatcaccgggaggacgacgccgaagccgaggccgatgacgaccggcgagccccagttggtgacgtcgaggtcgttggcccggcagagcgccgccaggccgatcaggagcaggggcaggggcagcaggagcagggcccggcgacggccgaagaggccgcgcgccgtgatcagggcgacggtcgacatcaggcctccagcaggtaggagaagacgctctccagggactcgtcggacggcaccagctggtgcagccggattccctcgtcgagggcgatacggggcaggttgcgggtgaagtcgccgtagtcggaggcgcggacggtgagcccgccgttctcgatctcgatgccggcgacggacttctcggcgatcagggcgaccgcgaggcgccggtcgtcggagctgcgcacggcgaacacgtgcggccggttcgtcatcagccggcggatcttgcggtagtcgccggaggcggcgagccggcccgcgacgatcacctggaccagcccggcgacctgctcgacctcctccaggatgtgcgagctgaacaggatcgtgtgcccggtgtcgccgagtgagtgcagcagctgcatcatgtgcatccgctgccgcgggtccatgccgttgaacggctcgtcgagcagcagcacccgcggctcgtggacgagggcggcggccacccgggtgcgctggcgcatgcccttggagaaggtgccgatccggcggttcgccgcgtcggtcatctcgacgagctccagggcgcggcgggcggcgccggccgggtcgcgcagtttctgcatcttggcgcaggccagcacgaactgctcggcggtcaggaaggagtgcaccgcctcgcgctcggtgaccaggccgaggtcgcggtagacgcccgggttgcgccaggtcggggtgccgtcgatggtgacggtgcccttggacggggcgaggaagccggccatcatgtgcaggatcgtggtcttgccggcgccgttcgggccgagcaggccggtcacgccggagccgagcgacatggtgatgtcgttgaccgccacgacgttgccgtaccagcgggacacgccctgcaggtcgaccacgccgggggtggccgccgcggcgggtgcggcgggcgccgtgggctgggtttcgagggtcacagcgcggccaccttccggtagcgggcgagcaggagcaggaggcaggcggcgatcaggcagagcgcctcgatgccgtagatcgggccgaaccgcccgagatcgaagtcgatgctggtgtcgaacagccagtggccgacgcccgcgatcagggtgttcgggctggccaggaacgccagctgccgggcgttgctggagggcaggttggccagcaccccgacgaccggggtggtcatcaggaagaccgcgacgataccgccggcggcgaacgcctgcttgccggtgaacgaggcgatgagcaggccgatgctggtgaacagcagcgcccagagcaggctgtagccccagccggggagcagcttgaggacttcgtgccagaccccggacatgcccttcttggtggtgaaggcggagcccaggaacatgatcagctgcgggacgccgagcagcagccagaccgcggtgaccatggccaggaacttggcgagcacgtagtcggcggcgcgcagcgggcggctgaagtacagcggcagggtgcccgagcggatgtcccgggagaccagggccggtgccaggatcgcgacgaagaagatgatcatccagctgagctggtcgtcgaggtcggcgtagccgaaactgaactcggtcacctgcgacttgaccgcggcgatgatgatcgcgaacagcagcgccacaccggcgaccatccacggaaagatcttggccttggcggaccggccgaacccgaacgcggcacgcaggccgtggacgtagagtgccccgatcccggcggagcggcccaggcgtggcccggagtaccgctgatagccgatgtcatggatgacgccggtctcagacatcggcggtctccttcgcggtgaagagctcggcgacacggtgccggcgctggtccaggcggtgcaggttgagttcgaggtcggtcaccgcgcgcaggatccggtcgtacgcctcgtcggagtccatcgggacgagcagcatccggttctcccgggtgacccgcaggccggcctcggtgagccgggcggcgagctggtcggtgccctcggtgacctcgaccgccagcacgtcggaggcggcggtcatcgaggagatccggtcggcacgcagcagtcggccgccctggatggcgatcagcgagtcgcagatccgctcgacctcgccgagtaggtgcgagcagaccaccacggagatgccgaactcggtgccgatccggtggatcagggcgagcatggcgtcccggccggccgggtccaggccgttggtgggttcgtcgagcagcagcaggtcggggtcgtggaccagcgcctgggccagcttgacccgctgcttcatgccggtcgagtagccgccgatctgccggtaccgctcctcgtagaggccgacgtggcgcagcgcctcggaggcgcgctcgcgggccgcggtgcggggcaggccgctcatccggccgaggtgggtgacgaattcggcggccgacacgtccggcggcaggcagtcgttctccggcatgtaaccgacccgggcccgcaccttgtcggtgtcgacgaccgggtcgatgtcgaagacgcgaaccgaaccggcgctgggagtgatcaggccgagcatgattttgatgaacgtgctcttgccggcgccgttggcgccgacaaggccgatgacgccgggctcgaccgagacggtcaggtcggacagggcggtcaccccgcccccgtacgtcttggtgagcgcttgagtagcgatgatgttcacggcctcagcctagaaacccatcgcacccgtgcggatccggaaggaccctgaggccatctcagggtccctcagcttgttcacaggtttgtggagacctcagcggaccgcgacctggaagaccggaagccggcccagcttgcgatattcgcgcagggcggccggggtgcagtccaccgacgagtcctggcccttctggttggccggtgtctcgaagtgcaccatcgccttgatcgccgggaaatgcccgatctgctggcccacctcgcggtagaacgcggccatgtgcccggggtggcgtttgctgaaccacaccccccactcggcgaccatcagcggtttgcgggggtgggcggcgcgcacccagttgtagaagccgggccagcgcggcttgagcgcggagcgccggttgagcagctcggcgaagtcgccgtggccgtaaccggggtcgctgtacgagtacgtgtcgaacccgatccagtcgaccaccgagtcccccgggtacatgtcggtgaaccagctctttgtggtgtgcggcacgtacgccatgtgcaccagcacggtgaccacgttcgtcgcgccgtgggcccgcagccgccgcaccacgtgccggaacatcgccgcgtagtccttcgcggtgtaccccgacccgggacgttcccggacctggtcctcggcctcgtggtggatcgcgaagaagaacggctcccggaagtcgcggtgcaggtgcaccgcgagctggtcgaggaacgcgtcggtacgccggtcgccgcgcgcgatcgccgcccaggaggcgctctccggcttccagttgagcagcaggatccgcttcttgccgggctgccgggcgatcgcgatctcctgcggcgtcgggaacagctgccggatcccgtggtggtaggcgtggaagatggcctgctgccgcccggtcttgcgctcgaactcggcgagcgcctcggccccgtggtcgtcggtgcgcgcaccgggcgccaccccccacaggatgccgcaggtgggcaccagcagccggccggtggtgcaggtccggtggacggcggcccgggccgggaagctcccggtcagcgggctgtcggcgccgctgagcacggcctggcggagccgggcggagccgggcggcgcggggtcggccgcggtgccggccgtcgtgcccgggtgtgggccggccggtgcggcggagaccaccgggtcgccggcgggcagccggccgagttgctccacgccgccggtccaggcccaggccagagtgaccgccacggccatcgtgaaggcggtgccgaacgcggcagaacgtaaggtctgtctcacaatcgccctatattaggggatcctccgataaagtccaaaaagtcagcaatcatccgttagcgggtatagcggcgggacagcgagatcgtgagcccgcctcgaccggttcgaatcgggctgcgaaactgtcacccaagtcggccggcaaggggataacaacggtgagtggctcggtactgcccgaagacgtcctccgggacgcaccctcgttcgcgccgcgcccgtacgagctggccgatctcgaactgctgctctccggggcgtacgcgccgctgaccggattcctggtccgcgccgacctggtcgcgctggcccgcaccgggcgactggccgacggcaccccgtggccggtcgcggtgaccctggagatcccgctcgacctcgccgagcgcctgaacccggccgacccggcacggcgcaccgtggtgctgaccgacctggagggcgcgccgatcgccgcgatcgaggcgcgcgacgtctggcggatcgccgacaaccggtacggcgtgggcggcccggtgcagcggatgggcgacggcgggcacggcccgttccagcgtctgcgccgctccccggccgaggtcaaggcgctgctgccaccgggccgggtgctcggcgtgatcgccgaccggccgctgcaccgcccgcagctcgcccagatcgcgcacgccgcccgcaccctcgcggcccacctgctgatcatgattccggtgagcgggcacgggccggacggcctaccgcccgaggcactggtccgggcggtcttcgcggcccgcgaccggatgcccccggccaccgtggtcgcggtcccgctgatgccgcacggcgacgagatgcgcgacgcgctgctgcgctcccgggtcgccgcggcgtacggcgtgacccacgtgctctccaccggcgagtcgctctccggagccgggctgcgggtactggtgccgcgcgaactcgcctacgacaaccgggacggccagtggcgctggcgcgacgacatcccgccgcgcaaccgccggctggcgatgaccccggacgagatcgacgacctgctggaccgcggtttcccgctgcccgagtggcacaccccgccggcggtcgccaaggaactggcccgggtccggccgccgcgccggcaccgcggcctggtgctgttcttcaccggcctgtccggctccggcaagtcgacgatcgcccgcaacctggccgacgcgctgcgggagaccggcgagcgcacggtcaccctgctcgacggcgacgtggtgcgccgggagctgaccgccgggctgggcttcagcaaggccgaccgggaccgcaacgtgcgccggatcggctgggtcgccgccgaggtcggccggcaccgcgggatggcggtcgcctgcccgatcgcgccgtacgaggcggcccgcaccgcggtgcgccggatggcggccgaggcgggcgccgggttcctgctcgtccacgtggccaccccgctggaggtctgcgagcgacgggaccgtaagggcctgtacgcgcgggcccgggccggtcagctgcgcggcatgaccgggatcgacgacccgtacgaggagccgctggacgccgaactgaccatcgacaccagcacgatgtcggtggccgaagcggtcgagatggtcctcggctacctggtcgagaacggctgggtggagcccaagctgagctgaccggcgtcgcgccccttgccgctgacgtcgagagccgcagaagaccagggcttcgcctggcctttctcggtcctctcgacgtcagcgggcgcaatgcgtggtggtttcaccaaccctgcgaggcatggggtcgagctgacccatcactcgcggctgggagtgggcgttagcccttggggcgaaacgcccaaaatcctcctcgaaaggccgcggaaaccgatggaagcgtcacgcccaccgtcctccgatgtcgcgcactacctgggcgcggttcgccggcactggtggatcgccctggtggccacggccgccggcctgggcgtgggcgccgccgtcacgcactcgctcccgcgcgtctacgagtcctcgtcgtcggtcctggtccagtcggtcgaccaggacgtgaacgcgcagggtggccgcaccaagggcgcggtcaacctggacaccgaggcccagctggtcggttccggcgcggtcgccgccaaggccgccgcgctgatgcgcaccacggtgtcgccgctggagctggcgcattcggtgtcggtgcaggtaccggcgaacaccacggttctggtgatcactttccaggcggacaccccgatgaaggcccaggccggttcgcacgcgttcgccgaggcctacctgcgcaaccgtgaggagaccgcacgcggcctgctggacaagcagatcgcctcactgaacctgaaggtcaagcagctcaccacggcgctcaccgggatcaacgccaagctggccgacgcccggccgggcagttccgcggagagcaacctgcagagtctgcgcagcaactcgcagaaccagctgaacagcctcaccggccggctcaacgagctgaccaccaccacggtcggcgccggcgcgatcatcagcgacgcccggctgccggacaccccgtccagcccgaacacgctgctggacatcgccaccggcggaatgatcgggctgctgctcgggctggccctggcgtacctgcgggagcggttcgaccggcgcctggtgaccgcggccgacgtgcgtgaccgcggccgggtcgcggtgctggccacgctcgacgagcggaccacgccgcacttcgacgacgtgctgcagccgtacgggccgggcggccgcgtcttcaaccgcctgcgcaacgaggtgctggccagcctcgacccgcacgaccgggtgatcgtggtgaccgggaccagccgcggctcggcgagcacgctggtcgcggcgaacctggcggccgccctggcccgcaccggcagcgacgtggtgctgatcggcgcgcacctgccggacagcgtggtggacgccgcgccactggcccggatgctcggggtcgccccggtgcccggcctgtccgagatgctggccggccgggtgtcgctgagccgggtgctgcagcacaccgcccggatcccggcgctgcgggtgatcaccaccggcggcgcggcgaccgcggccgggctgatccagtcgcagcggctgcgcgacaccctggaggcgctgcgccggcagggcgggtacgtggtgatcgaggccccgtcgaccagcagcagcgccgacgcgcagagcctggccagcctcgccgacgcggcgatcctcgcggtcgagctgcgccgcacccgccggccggccctggtcgacgcgaccgagcagctgcagcgggtcggcacccggctgctcggcgcggtggtgctgccccggctcaacgtcaagcacaccgccgagccggccgccgcgcccgcggtgaccctgccgccgaccggcaccgagccggtcgtcgaggaggccacccagcagctgtcggcactcaaggaccgcggtgagccggtctcggccacggtccggcagcggccggccgacggcgacaccggcgagcagacctcggttgtcgaaggctcgggcgccacggacggcgacgagaagtgatcacggtcgtcccggcggcgccgcccgccggaccggcccagcaccgggccggtaaggacctcagcctgccggcctggccggtgaccgggatcctgctgctctacccgctctggtgggcgctcggcctgggcgtgctgatcttcccgctggtcgccgcgccgatgctgttcctgctgatccgccgccgggccgcgggccgcccactgcgcctgccaccgggcttcacctggtgggtggtgttcctggtcgcggtggtggtgagcatcgccgcactgggcgccgacccggcgcagaccgtggtcgagcgggccgtcggccggctgcccgcggtgctctacaagctggccatgtacctctcgctgaccgtgctgctggtctacgccgggaacctgaccgagcgggagctgccgcggcggcggatggtccggctgctggccggcatgttcgtgctgaccgtgctgggcgggctgctcggcatggtggccgggcacttcgagttcacctcgccggtcgagtggctgctgccgcagggggtgcgcagcaagggcttcgtccggtcgctggtccacccgtacgccgcgcagatcatggacatcgtcggcggtgacgccccgcgtccggccgccccctgggggtacaccaacacctggggcaacaacttctgcctgctggtgccgtggctgctggtggccgcggcggccgcgcgcagccggggccggcgcgccgtgctgtgggtgttcctgctggtctcgatcgtgccggcggtcgtctcgctgaaccgcggcctgtggatcggcctggggatcatcggcgggtacgccgcggtccgctacgtgctggccggcaagttgtgggtgctcggcgtgctgctggtggcgggcggggcgctcgcggtggcgctggcggccaccccgctgggcaccaccgtgcaggcccggctggacaacggcaagtcgaacggggtccgctcgttcctgatcgagcgggccatggccgggttcaccggttcgccggtgatcgggtacgggggcacccgcaacaccctcggcggccgcaactcgatcacggtcggcgagagctcggagtgcgagcgctgcggcaacttcacgatcggcggcaacgggcagctgtggcagctgctgtattcgcacggcgcggtgggcaccgcgggctacctgggcttcttcgcgtacgggctgtggcggttccgccgggaccggaccccgatcggggtggccggcagcgccgcgctggtcagctcgttctccgcgatgctctggtacaactcgctggtcacccccctggctttcatggttctggcgtacgcgctgctctggcgcaactggatcgaggggaacgacgacaattgagtccggtcaaaacggcgccagccgagctcacggcgggcgacgccgcactgcgtacccagtatctgaccgaggtcatggcgctgctctatccgccgccgtgccgccccgcccgcgaggacgacggtgcgggcaacacgatcgtggaatacctggtggtgccgaacgcgcaccgcccccgcctgctggtgccgaacacctccgccgcggtcgccgcggccgcggtccgccggtacgccgagccgcagtcccggatggcccggttcaagcgggacgccgtggtggccgcggtccgcacccggaccgaccggctggtcttccgcgaccggatccgggtctccggcccggtgtcggccagcatcgacggctacctcagcgacgcgctgcggcgcgacctgtcggtcagcgtccacatcggcccggcccgggccaaccgcaaaccggtgctgcagttgctcaccccggacggcgagaccttcgcgttcggcaagatcggtgccgggccgctcacccagcgcctggtcaaggcggagaccgcggcgctgaacgcgatcggctccagcggactgaccaagctgaccatcccccgggtgatgcacgccgggcagtggcgcggcatgcaggtgctggtccagtcggcactgccggtgtggctgccgcgcgcgccgctgaccccgcgccggctcaccgccgccatgctggacatcgccggatgctgcggctacaccaccggaccgctgacccagagctcttactggcacgagctgcgggcccggctggccgcggtctccgaccgggccgagggcgccgcgctgtccgccgcggtcgacctgctcgccgcgcacagcggcgagcacaccctgcgctacggcgcctggcacggcgactgggccccgtggaacatggccaacctcaccgacgcgctgctcgtctgggactgggagcggttcgccaccggggttccgctcggcttcgacgcggtgcatcacgagctgcagagacggatccagaccagcggtgacgcgcggggtgcggtggaggccaccgtgcgccgggccgacgagctgctcgcgccgttcggggtggccgcggtggcccgcgagacgaccgccctgctctacctggtcgacctggccgtgcgctacctgaccgaccgccaggccgaggcgggcgcccggctgggcgtgctcggtacctggctgctgccggtgctcatccggcgtgttgaggagctgtgatgaacgtccgcaatctgcccgcgccgatgaaggcggtggtgcacctgggctcccgctcgtacggccggctcaccgccgaccaccggatgctgccgtccttcctgatctgcggcgggcagcggtgcggcaccacctcgttgtaccgggcgctggccgcacatccggtggtgctcaaggcggtgctccacaagggcgtgcactacttcgacacgtcgtaccaccgcgggctcgactggtatcgcgcgcatttcccggcgcggcgggcggccgagaagatcgccgagcggttcggggtgccggcacagaccttcgagtccagtccgtactacatgtaccacccccaggcggtggcccggatcgcgcgggacctgccgtacgccaggatcgtggttctggtgcgcgatccggtggagcgcgcctactcacagcatcaccacgaggtggcgcggggtttcgagaccgagcgtgacttcggtgcggcgatggcgctggagccggcccgcctgcaccggcaggaggaacggctggccgacgacccggcgtactacagcttcgcgcaccagcaccacgcctaccgggggcgcggcgaatacgcccggtatctgagcgtgatggcgcagcacgtcggccgggaacgcatccacgtggtggagagcgaacggttcttcagcgacccggagccggtgtacgacgaggtctgccacttcctcgggctgccaccgcacctggaacgaccggccttcgagcggcacaacgcccgcccccggcaggccgacatggacccgcagctgcgccgggaactgggcgcctactaccagtcccacgacgaggcgctggccggctggctggggcacacgccgatctggcgccgcgggtgacggccggcccgctgaccgacccggcgccaccgcgggccgatccgggccggggcactcgcggcgcggcccgtggcggactcgccaacatggccggatcggcactggccggaggcgccggcgtgatcgtcacctgggtggtggcgcgtcgcctcggcaccgacgaggcgggcgcgttcttctccgccaccgcagcgttcgtgctggccggcgggctggccaagctgggcaccaacaccgggctggtctactggccggcccggttgcgggccaccgggcgtgctcacctgctcggcacctgcctgcgtaccggcctcgtcccggtcttcgtgttctcgctgatcctcgcggtggcggtgtgggccggcgcgccgcagatcgcccgggtcaccgcgcacgactcggccggtgcgtacctcaccggtttgcgggtgttggccgtcttcatcccgctgcaggcactcaccgacgtgctgctgacgatcactcgtgggtaccgctcgatgcgccccaccgtgctgctggaccggacgctgcgcagcgcactgcaattgctcggggtcggtgcggccggcctcctggcggcagcttcgctgccggtcttcgcgctggcctgggccgctccctacctcccggtgaccctgtttgcggcgtacgcggtgaggcggctctacctgaccggacgccccgccgcggcggccagccgacgggccgaacgccggcagctgcaccgggaattctggcggttcaccgcaccgcgcgcgctggccgccgtggcccagctcgccctgcaacgggtcgacgtgctgctggtcgccgcgctgggcggcctcgggccggccgccgtctacgcggtcgccggccggttcgtgatcctgatccagttcgccaaccagggcatctcccagtccgtgcagccccggctggccgaggcgctgagcatcggcgaccgggacgccgcgaatcgcctgtaccaggtggccaccggctggctggtgctgatcacctggccggtcagcctgctcgtcatcctgttcgcgccgtactacctccgtgtcttcggcgccgggtacacggccggcaccccggtggtccggctgctcgcggcggccatgctggtcgccaccggctgcggcatggtcgacatggtcttgtcgatggccgggcgcacctcgctgaacctcggcaacgtgctgatcgccctggtcgtcacgatcggcctggacgtggtgctgatcccccggtacggcgcgatgggggccgccgtgggcctggccggcgcgatcgtcgccaacaatctgctgccgctgatccaggtgttccgcggcgcccgcctgcatccgttcggcccgggcacccgggccgccgcgctgctctcgaccggctgcttcggcctgctgccccgggcggtgaccgccctgctcggggacggcccggccggactggcgccggccgtcgcggcagccgtgccggccttcgccgccggcgcctggctgctccggggccggctcgaactcggcgcgttcacccgacgaaagacccaggaggcgagttgaccagcgattacaccgaggtgttccaggacaccgaggcggtcgagaagtacgagtcgatcacgtacgcgccggacagttacgcgtcccgcatcaacgaccggcagcgcgactacctgcgtgccctggtccgccgcgaattcgagggtcagcacccgccggtccagcacgacttcgcctgcggcaccgggcgggccatccgcaccctgcacggcctggtccgggaagcgcacggatacgacacgtcggccgagatgatgacgaaagcggccgaggtcggctcccgcgcgtactggcaccgggtgtcgatcgacggaccggtcccggcgccggtcgcggccggcttcccggccatcgtgaccatcttccggctgctgctcaacgtggacgacacggtccgcgaccgggcgctcgccttcgccgcgaaagccctgccgcaccgcggctccggcctgctcgtcgtcgagaatcacggcaacgccggctccgtccggcacctgcgggcccggcggcaccagggcgaacgctggttcgccgagctctcccacgaggaggtcgcggcgctgctcgaccggcacggcttcgagatcgtcgaacggcgcggcttctccatgctcaccccgtccctgcacgacaaccggctggcccggctcgccgacgcggccgcccggcggctgcccggcaccgacggttacgcggtgaacgtgctgtacacggcgcggcgggtccatgcgtagggccgggctcggcggggtgctcgtcggcgtactcctcatcctgtccgcctgcagtggcagccaccgcgggaatcccgcgccgccgccgtcgccggacctgaccgcgcggccgccggccatcgcggtgcaggacggtccgttcgccgccggaccgttcacgcctccggcgacgggggcgtacgtcggcgcctggatcaagccggaccagctcacccacatcgggcgcctggaagcggtcgacacgttggaggcgtcgctgggtcgccggctcgacatcctgaacacgtatcgtcgcttcgaccagatggtcgggaccgaatccgatcaggagttcctggctcaggggcagtcgctgatgatcagctgggcgaccggcgacaaccggtccatcctggacggcgaacacgaccggctgatccggcagcaggccgaggcgatccggaggatcgggcggccggtgctgctccggatgcgctgggagatggaccggcccaacctgcgggccaccatgtggtccggcgccgactacatcgcggcgtggaagtacgtgcgggcgatcttccagcgggagcacgcggacaacgtgtcctgggtgtggtgcccgaccgccgaaggcttccagcgcggggatgcccagcagttctacccgggcgacgatcaggtggactggacctgcgtggacgtttacgccggcgccgacttccagccgatcgggcaactcatggggcccttcctgcagtgggcggcacaacggccgaaaccgatcatcatcggggagttcggggtggcgaaagcctggggatccgcgaaccgggcggcgtggctgcgcgacgcggaacgcaccttcaaggcgaaccggcagatcaaagcggtcgcctatttcgagtcggacccgacggggaacgggcccaaccagcagttccagctgagcggggacaaggcggctttcaaggcgttccacgcgctcgccaaggatccctacttcaacgtcgggcgctgaggggttttcgggaccgctctccggccgcggcttgctctccggccgcggcctgctctccggccgcggcatcaactccggatgggctccaggaactccagccggtttccgtggccgtcggcggagtagaggcggtggtggcccgggaagtgcggatcccgctcgaccgggtggccggccgaggtcaggacctcggccagggcgtcgagatcgcggacgaggacgccggggtgagccttggtggccggggcgaaatcggggaccgggctgaggtggacctcccagccgccggcgcggaaccagcaaccgccccgggcggccaggaccgggggcttgacgatctcggccatgccgaggacgccgctgtagaaggcgcgggccaccggttcgccgccgggcgggatcaggagctggacgtggtgcaggtcgtcgatgcggaaggtcatgcgaagactttaacagtacgctcgtactgctaacgagtcccggaaaagtgtcgtacatgtgttccatagtgaggctcagtggtgccggccccgtccggcgccccgctgtccgtcagcaccgagccagggggccccgcgatgtccgacttcttccgtgagcagaccgagatcatccagcagttcggctgggccgtggtgcatgtggtgcccaccgacgaggaagcggccgacgacgtggcgccgttcgcctacacggtcgggctgaccgccgacagccacccggagctgatcatcgccgggctgccgcccgacctggcccaccagctgctcaacgagctggccgggcgggtgcacgaggagggcgcccggttccggcacgggcgacgggtgaccgatctgatcgtcgagcaggacgtggtgctgctgaacgggtcgccgaccgcggaactgtggccgggcgccgccctcgcgcggtatgggcggcgggtccgcctgcaacagctggtctggcccgacccgggaaaccggttcccctggcaggcggggtattcggatgccgaccacgcccagccgctgatcgacgcgccgccggccacgatggtccgttgcggttcgccgcgcgggttggccggcccgcgcgggcggcgttccgtcacccgccgcggcccgatcccctgacgcacgaccgcgggcggtcggtccttccgggcggtcccgggcgggggtcccgggcggtcccgggcgggggtcccgctagctagctagtcgggcccgggccaggaggcggagggcatatggagcgtcgtggcgcagatagcggcgggccaggcggcgaggttcggtggtgaggcggtgggcccattcgaggccggtgcgttgcatccagcgcggggcgcggtggatgtcgccggcgacgaagttgatggcggcgccgcaaccgacgaaccaggtggccgggaggtcgcggcggaggcgttcgatgacctgttcctgcctggggaaacccaggccgacgaagaccaggtccggctgggcggcggtgacccgggcgcagacctcggcgtaggtgttctcgtcgtcgtcgaaaccgaaaggggggctgagcgcgccggcgatccgcaggccggggttcgcggtggcgaggcgcaccgcggcccggaccgcgccggacgcccgcacgtcccggaccgtgacgccggtggcgggcgcggacccccggccgccgacgatcggggcttccgcggccgggtcggccggcacgatatcgcccgacgtcggcgcggcaggcgggcgccgagtgacggactcggcgaccgggacattcgccgtccaggtttcgccggagagggagttccagaccagcgtttcggtggcgggggcggcagcggtccccggagccgagaagtcgcggtccggggcgccggaaggcgcgcgatcgcaaaggacggcaaacgggcggcccggggcagtggacgatgcgcggtcgggggtggcggaaaacgaacggtcgccgggggcggcggacgcgcggtccggggtggtgaacgaggccgggtcgcggagagcggcgagcgcgcggtccggggaggacgaggccgggccggggagggcgtgcagggttcgcggggtgggggtgccgccgaggatgaagatggagcgggtgtcgcggcccaggccctcggagagggtccagatcaggctgctgccggccacccgctcgggcagggggacgccgccgaggcggctggcccagatcaggggcatgccgtcggccacgatcaggtcggcgtcgtcgaggtggcggcgggcggccgggtcttcggcggcgcggcgcaggatgtcgacgttcggggtgatgatgcggccgccgcggccgtgcgagagggcgtcgcggacgaccgccaccacctcgtcctcggtgatccggtcgatgccggtgccacccaggtgcacgcggtcgaaagcctcgataaccacctgacgcctccttttgcctgcttcactcgttaccagagcgaaacgattgaaggcgggccaaagtggcacaagtgctatttctgggcggattagggcgaagcggcacgacgctcgtggaacgcctgctcggtgagctgcccggggtctgcgcgctcggtgaggtcgtccacctgtggcagcgcgatctacgcgacgacgaacgctgcgggtgcggggagcggttctccggctgcgacttctggaaacgggtgggcaagcacgccttcgacggctggaacaacgtcgacgtggaccgggtgcacgcgttgcgggacgcggtggagcgaacccggcacatcccgcggctggccgcgaccacccacccgggcgccgcggtgcgggagtacgccggctactacgccaaggtgtacgccgcggccgccgaggtgtccggcgccgacctggtcgtcgactcgtccaagcattccgccctggcgcacgtgctgcgcgcggccggccaggtggatctgcgggtgctgcacgtggtccgggacgcgcgcggcgtcgcgtactcctggaccaagcgggtggcccgcccggagaccgacggcgcgcaggagatgacccgctactcccccggccggtcggcgctgctctggaacgcgcacaacgccgctttcgggctgctggcccgccgcggtgtgccggtccgccggatccgctacgaggagttcctggccgacccgcgggccgcgctgatccggctggccgatttcgccgggctcaccctgcaccccgaggacctggacttcctgcgcccggggcacgccgacctgcgggccgggcacagcgcggccggcaacccgatgcggttcaccgtgggccggctgccgctgcggcacgacgacgcgtgggtccgcgccctgccgaccgtgcagcgccgcctggtcggcgcggtgtgcgcgccgatgctccgcgcgtacggctaccccctgaacccgcaggagtcacgatgaactggccgtcggtcggggtcgtcatccccactcggaaccgccccgagctggtccgacggtcgatcgccgcggtgcgcgcccagaaatatccgggtgagcttcgggtggtcgtcgtctacgaccagaccgagccggattacctgctggcgcagaccgacggcgtaccggtgctggtgttgacgaattggcgggccgccggcctggccggcgcccggaacaccggggtgctggccctggacaccgagctggtggcgttctgtgacgacgacgaccgctggctgccggacaagctgcgtcgccaggtggccgcgctgctggccgagccggacgccgaattcgccacctgcgccatcgaggtggagttcgaggggcacaccacgccgcggctggccggccggagccgggtgacggtcgacgacctggcccggtcccggatggcgatgctgcattcgtcatcgttcctgatccgccgggaggcgctggccgaggacgcggtgggcctggtcgccgaggatgcgccgggcagccagaacgaggattgggatcttctgctcagggcggcgcgccgctcgccgatcgtgcatctggacgagccgttggtgcaggtgctgtggggccggagttcgcactacgcgtacgagtacgccaccaagatctcctcgctgcgctggatgatgcagcggcacccggagatcagtggctgccgcccgggggccgcccgggtgtacggacagctcgcctgctggtcggcggcgaccggaaaccgcagccaggcctggcagttcagcaaggaggcggtgcgggcgaactggaaggaaccccggaccgcgatcgcgctggccgcgatgaccggagcggtgaaggtggagaatgtgctttcagcgctgcacaagcgaggacgtggtatctgaagtcactctttcgcgcacacccgagcaggcggtactgttcaagtgtgtttgaattagtgcggaacccacggcagaagatggtggattgctgatgttggcccagcaacgccaagccgcgatcctcgaccgggtccgcgccaccggcggcgtccgggtcagcgagctcgccaccgagtacggcgtctccgacatgaccatccgccgcgacctggaagccctggccgaccgcgggctgctcgcgaaggtacacggcggtgcgaccacggtcagccccggttccgcacacgagccgggcttcgccgccaagtcggtccgccagcgcgacgagaaagccgcgatcgcggcccggggcgccgccctggtctcgcccggcgacgcgatcgccctctcggccggcaccaccaccgcggtgctcgcgcagcggctggtcgacgtgccgtcgctgaccgtggtgaccaactcgatcccggtcgccgacgtcttctaccgcgccggccggcccgaccagaccgtggtgttgaccggcggcacccgcaccccgtccgacgcgctcgtcggcccggtcgcggtggccgcgatcggcaccctgcacctggacatgctgttcctcggcgtgcacgggatgagtgagcgggccggctacaccacccccaacctgatggaggcggatgtcaaccgcgccctggtcgaggcggccgagcgtctggtcgtgctcgccgacagcaccaagtggggcacggtcggcatctcgtcgatcgtcccgctggagcgggccgacgtgctgatcaccgacgacggcctggacaccgccacccgcaccctgctcaccgaaaccgttcctgaactcgtggtggtgaacccccagtgacgttcttccgctcgaccgtcgcactctccgacgggcgcgagctcatctacttcgacgagaaggccgattccagccgctcggcgttcccggacacccgcgagctgccaccaccgccgccggcgtcccagttgcggtacgacccgctggtcgacgagtgggtggcggtcgccgcgcaccggcagacccgcaccttcctgccgccgtccgacgcctgcccgctgtgcccgagctcgtcgcggttcgccagcgaggtcccggcgccggactacgacgtcgtggttttcgagaaccagttcccgtcgttcagctaccgcgaggtgccgggcggcgacatcaccgagctgaccgacatggtgccggtcaagccggggctgggccgctgcgaggtggtctgcttcaccagcgaccacaacagctcgttcggtgcgctgccgccggcccgggtgcgcaccgtgatcgacgcgctggccgaccggaccaccgagatgtccgcgctgccgggcgtcgcccaggtcttcccgttcgagaaccggggcgtcgagatcggggtgacactgcaccacccgcacgggcagatctacgcgtacccgatggtgccgccgcgcaccgccgccatgctgcgggccgccgccaagcacgcggagcggaccggcgggcgcaacctttacgccgacgttctcgccgccgagcaggaggcgaaggtccgggtggtcgccgccaacgagctgtggacggcgtacgtgccggccgccgcccgctggccgttcgaggtgcagatcgccccgcaccgacaggtccccgacctgcccgcgctcaccgacgaggaacgcgacgcgctcgccccgctctacctcgatgtgctgcgccggttcgacggattgttcggcaagccgatgccctacatctcggcctggcaccaggccgtcgtcggcgagggccgcgacctcggctacctgcacctgcagatcttcagcatccgccgggccgccgacaaactgaagttcctggccggctcggagtcggcgatgggcgccttcgtcagcgacgtcgtcccggagaaggccgcgcagctgctgcgcgacgccggctgaccccggcccttcaccgcggcccgccaccacggcctcagcgcggcctgccaccgcggcttctcaccgcggcccgccaccacggcctcagcgcggcctgccccaccgcggcttctcaccgcggcctgccaccgcggcttctcaccgcggcccgttcctccgaacgggccgcgcttgcatttccgcagaccgcagacgccgaagtaggaacgccagacaacccagcggaggtcgcggacgctgagacgcgaagggagagccagggcggccacgggcggcgagccgcgaaccgaagagccagtggggcatggacacggagatgtgatccgaagagccggcgggggttcgggcgccggacgggaacggtgggggtgcgggtggcgaaaaagggaccagcgggggcccgggacaaggcccccgctgaaggggacggcgagcggcgtacccaagtccgccacccgcaccactcagagaaacgaggccacataccccgcggttacgatccgaaacatccgatttgcgaagtttttcgtccgcttaacgagcactcaaaaccaaccgctcatttagtacgtcgccagccgcatccgtccggccccatcttggctcgtcgcacaccgcagccaggcgccagcaccgcgggcacggcgggcacggcgaggcagcgggctagctagctaggggcacggcgaggcagcgggcaggggcagccggcacggcgagggcagcgggcagcgggcagcggcacggcgggcttggacaacgcgtaccgccacattggatttgatcttggaaatggatcgggggaagaggctcggccggccccctcccccacggaagtgcggtgatgctgtgatgctgtggtgcgaaatcaggcgagcttacgcgccaggttctcgtcgagcgcgttcatgaactcgtcggtcgacagccacggcgcgtccttgctgatcagcagcgcgaggtccttggtcatctgaccgccctcgacggtctcgatgcagacctgctccagagcctcggcgaactgggtgacctccggcgtcccatccagcttgccgcggtgcttgagcccgcccgtccacgcgaagatcgacgcgatcgggttggtcgacgtcttctcgcccttctgccactgccggtagtgccgggtgaccgtgccgtgcgccgcctcggcctcgacggtctggccgtccggggtcatcagcaccgacgtcatcaggccgagcgagccgaagccctgcgcgaccgtgtccgactgcacgtcaccgtcgtagttcttgcacgcccagacgtagccgccctcccacttgagcgcggccgcgaccatgtcgtcgatcagccggtgctcgtaggtgatcccggcctccttgaactggtcggcgaactcggtctcgaagatctccgcgaacaggtccttgaagcggccgtcgtacgccttcaggatggtgttcttggtggacaggtagaccgggtagttgcgggccaggccgtagcgcagcgaggcgcgcgcgaagtcgcggatcgactcgtcgaagttgtacatggccatgccgacgccgccggccgggaagtcggccacgtgcatctcgatcggcgcggaaccgtcctccggggtgaaggtgacggtcatcttgcccttgctgggcgccacgaagtcgctggccttgtactggtcgccgtgggcgtgacggccgatgacgatcggcttggtccagccgggtaccagccggggcacgttcttcatgatgatcggctcacggaagacgacgccgccgaggatgttgcggatcgtgccgttcggcgaccgccacatcttcttcaggccgaactcctgcacccgcgcctcgtccggggtgatggtggcgcacttgacgccgacgccgtgccgcttgatcgcgttcgccgcgtcgatcgtcacctggtcgtcggtctcgtcccggtactggatgccgaggtcgtagtactcgaggttgacgtcgaggtagggctggatcagctgctcccggatctgcttccagatgatccgggtcatctcgtcgccgtcgatctccacgaccgggttcttgaccttgattttcgccatcggccggcgctcctctcccgaaaacacgcttagcagtacgagcgtactgcccactcgcgggaccgcgccgcgcgcccccgaactggtgatctgcctctaccatcccaggcgcgagcaccgctcagctgacgatcgcaccataggccctggtgaagtgcacggcctgggccaggttcagtttcgccccggtcacgtcgacgccgcgcagcggtgcgccgtccaggtcggcgccgcgcaggtcggcccccttcagcacggcaccggccagccgcacgttcgacaggtcagcgccgcgcaggtcggtcctggtgagatccgccccactcaggtcggcctcgcggagccggaccgcgccgaacctgacaccggacaggttctgcccttgcaggctgacgaaaccccagtcgccgccgtgcacggtgaggggccgcagcccgcagtcgtcgaaggtgctgccggtcagcttgcagtcgtcgaaggtggtgccgaagaacgagcagcgacgcagcgtggactgcaggagcgcggtccgctcgaagaccgccgcgttgaagcggcagttgccgaactcacaccgctcgaaggtgcacgcggtgaaggtggactcgctccagtcgacgtcatggaacacacagtcctcgaagtggacccgttcccgctcgtcgagcgcccagtccgcaccggagaaccgctcaccggcgacgtgccgtgcttcgttcatccgcccaccctgccagaagaaggcggtgccgggcagcgcacccgggtccggccgagcgaccgcccgcctactccgccaggccgcggttccgcatctgctggaggtgatccagaatctccgcgaaattcgaggaccgcttcggggcagccgccacgatgcaatccagcggagtcgtctcgaagcggctcaccgcgatcgagccgaacgagggcagctcggccggatcgaccgcttcgacgacgtgccggcgcagcaggaactgggtctccggatcccgccggaccagctcgcccggcacatagtgcagttgtgcggaggtgaactcggccgccgagatgtccagcgcccagtccacgtcccggtagaaccgctggatcgcgatcatgaacgcctcgcgcacctcggcgggcagcgacggattcggcggcatgatgaaccatctgcccacccggccccgcagggtgacgtgccgcaacgcgcacccgtggagattgagcgaaccgctcatggtcaccccgtcgaccagcacgtcctccaaccggacgccctggatcgacgattgcctgcacacgcaacgggtcagcctcgcgtcccggaccaccagattcaggcccggatcgtcgaactgcgccaggctggaaccgtcgaactcgcaccggaccaggtggaagcccgccagcgtccgatgactgccgatgctcttgaccctcgagaagtcccgcttctcgatcagctcagcgtcactcaccatcggcctcgaccaccatcttcctggccgagcgcacagccggccgcactgccgcgatcggggtggacagcgagaggccgggacgccgtcgcccccggcctctcggctgcggtgtcagtggaagaagtgccgcgtgccggtgaagtagacggtcaggccggccttctcggcggcctcgatcaccaggttgtcgcggatcgagccgccgggctggacgaccgccttgacgccggcctcgatcagcacctccaggccgtccgggaacgggaagtacgcgtccgaggaggcgacgctgccggccgcccgctcggcgccggcccgggccaccgacagtttcgccgagtcgacccggttgacctggcccatcccgatgccgaccgcggcgccgtccttggccagcaggatcgcgttgctcttcacgccgcggatcgcccgccacgcgaagaccagatcgcgcagcacctcgggcgacgccggggcaccggtggccagggtccagccggacgggtcgtcgccggtcgcgtcgatccggtcggccgcctgcaccagcatgccgccgccgacctgcttcacctcggccggcggcgggttccacgccggggcgaccaggatgcgcaggttcttcttctcgcgcaggatctccagggcctcgggcgcgaaggccggcgccacgatcacctcggtgaagatctccgcgacctggcgggccagctcggcggacacctcctggttgaccgcgatcacaccgccgaacgcggagaccgggtcacactcgtgcgccttgcggtgcgcctcggccacgtccgcgccgatcgcgacgccgcacgggttggcgtgcttgatgatcgccacggccggctcggtgaagtcgttggcactgcgccacgcggcgtccgcgtcgacgtagttgttgtacgacatctccttgccgtgcagctgctcggcctgggcgaggccggcgggcgcggcggggtcgaggtagagggcggcctgctggtgcgggttctccccgtaccgcagggtgtcctgcttgcgcagagcgatcccggcgaagtccggccagtccgcgggcgccagggtgctggccgtccagttcgccaccgcgatgtcgtactccgcgatgttgatgaacgccgtggaggccagcgctttgcgctggttcagcgtgaacccgccgtcgcgcagcgcggagaggatcgacgggtagcccgcggtggagaccaccaccgcgaccgacgcgtgattcttcgccgcggcccgcaccatcgccgggccaccaatgtcgatcttggcgatgcactcctcctcgccggccccggaggcgaccgtctcggagaacgggtagagactgctgaccaacaggtcgaacggctcgatcccgtgctcggccagctccgccgcatggctctccagccgcaggtcggcgagcagaccggcgtgcaccttcgggtgcagcgtcttcacccggtcgctgaggatctccgggaagccggtcagatcctcgacccgggtcaccggcacgccggacttctccacggtcgacgcggtcgagccggtcgagacgatctcgacgccggccgcgtgcagcgcctgggcgagctcgacgatgcccgccttgtcccacacgctcagcagcgcccgcttgatcggacggcggccctcatcggtgctcacggaatccgtaccttcctgttctcaatggtccagccctcccggaccaggcggccgacgaagtcgaccagctgggcccgctcggccaccttgatccgctcggtcagcgtctcctccgtgtcgtcgtcgagcacggggacgctgacctgggcgatgatcggtccggtgtcgacgccggcgtcgacgaagaagagcgtcgccccggccagcttcacgccgtaggcgagcgcgtcgcgtggcccgtggataccggggaacgacggcagcagcgcgttgtgggtgttgatgtagcggtcgccgaacgcgtccaggaactgcttgccgaccagtttcaggaacccggccgagatgaccaggtcgggccggtgcgcggcgacgtgcgcggtgagcgccgcgtcccagtcgtcgcgggtcggatacgccttgaccgcgtcgacgaaggtggggacaccggccgcggcggcgtggtcgagaccggcgatgccgtcccggtcggcgccgaccgcgaccacctcggcgccatacgccgggtcgcgggtggcttcgagcagggcttgcaggttgctgcccgatccggagatcaggacgaccaggcgggcgggcgcgggcgcagtcacctgagcaccctatccgggcagctcaggtcaaccgaaatcgggcggttaccgccggccgttcggacgacgcttcgggcgcggctcgcggaagatgcgggccgccgacgctcccaggatcaccgagatcgccgcgacgatcgccgcgaccaggcccaccgaccaggctgccgggccgatctgagccagccggccgtcccccaccgggccgccggagagcgcggcgagcacgcccagcaccacgccggccaccggaccggccagcagacccgcgccgagcagcagcgaccaggccggttccggggcgtccgcgccggaacccggcccgggccgccaggcgtgcgcccggccgtaccgcagccgctgggtgagcacccagccggccaccgcgccggcgatcaccggcagggcgagcagcagcgcgccggcgccgcccaccggaccgttcggcaggccggccagcagcggcagggtgggcaggtcgtgcacggtgagctgggtgagccggatcaccgagccggtgccgagcgcgaagcccggcccgagcagataggcggtggaccagatcgccgcgttccccgcgtaggcgacgctgaccagggtgattccggcctgtccggcgaccccggtgtgataggccgagatgattttggcggcatcgccgccgcccagggccaccgacaggccgccgaccgcggcgcccgccccgaccatcaggaacgccgcgaccaggccggtccgcaccccgtgccgcaccacgaccgggacccgccgggccaacgtggtcaccgcgtcgctgccgcgcagcgcaccgatcagcgccccggccacgccgagggcgagaaaatcggacgcggcgcgggcggtggagacatccgtgccgcgaccgtcgatcaggtgggcggtcaaggcgccgattgccgcgtacgtcccaccgacgcacgccgcgaccagcagcgccgcgccgaccccgccggagtgccgggccccgatcgcccgggtcacgtgcagcccggcccggccgagccgccacagcaccagcacggtgagcagcagcggggccagcccgagtgacccgatcgaggtgccgatcggcaccccgtggccgagcagccaggcggccgccccggccttggccgcgccggccagcccaccctggccctccagggtgcgggccagcccgagcgccgcggcgaccggaaggtagctgagcagggccgcccagatcgtggcgaaggcgaccgcgaccgggagcggggcccgcccggcacgatccggcgggcggcgctgcaccggcacccggacggtctcccggcggccgagcatcgcctcgtccaccacgacggtgtcccgggtgcccggcgtcggctcgtcgcgctgatcggcgtcgatcggcggggcctcggtgtcccgcacgacagactgcagcgcctcggcgaccgcgaacgggtcctccgagccgccgggacggtcggttgtgctgggcatcgcgacctaccttgtcacgccgtggcactcacggcgatgcagatacgacggcgcgccgccgatcgggtcgtatcgacccggcccgcggcgcgccgttgctgccgaatcgatggtcagctcatgatctcgcgcatgagccgcgcggtctcgctcggcgtcttgccgaccttgacgccggccgcctcgagcgccgccttcttcgcgtcggcggtgccggccgagccggagatgatcgcgccggcgtggcccatggtcttgccgggcggggcggtgaagccggcgatgtagccgaccaccggcttggtcacgttcgccttgatgaactcggcggcccgctcctcggcgtcgccaccgatctcaccgatcatgacgatcgcgtcggtgtccgggtcgtcctggaacgccttcagcgcgtcgatgtgggtggtcccgatcaccgggtcgccgccgatcccgaccgcggtcgagaaaccgaagtcgcgcagctcgtacatcagctggtaggtcagcgtgccgctcttgctgaccaggccgatccggccctgcggggtgatgtcggccgggatgatgccggcgttcgaggcgcccggcgaggcgatgcccgggcagttcgggccgatgatccgggtcttctcacccttgctgacgttgtacgcccagaaggcggccgagtcctgcaccgggacgccctcggtgatcaccacggcgagcgggatctcggcgtcgatcgcctcgaccaccgcggccttggtgaacgccggcggcacgaagatgaccgacacgtcggcgccggtctccttgatcgcctcggcgacggtggcgaacaccggcagctcggtgccgtcgaagtccaccttggtgccggccttgcgcgggttcaccccgccgaccacgttggtgccggcggcgagcatccggcgggtgtgcttggagccctccgagccggtgatgccctggacgatgaccttggagtccttggtgagccagatagccattagttcacttccccgcagccgcgagctcggcggcgcgcgcggccgctccgtccatcgtgtcgacccgctcgaccagcgggttgttggcgccgtcgaggatggcgcggccggcctcggcgttgttgccgtcgaggcgtacgacgagcggcttggtcaccgtctcgccgcgctcggccagcagggcgagagcctggatgatgccgttggccaccgcgtcacaggcggtgataccgccgaagacgttcacgaagaccgacttgaccgccgggtcgccgagaacgatctccaggccgttcgccatcacctgggcgctggcgccgccgccgatgtcgaggaagttcgccggcttgacgttgccgtgcttctccccggcgtaggcgaccacgtcgagggtcgacatgaccaggcccgcaccgttgccgatgatgccgacctcgccgtcgagcttgacgtagttgaggttcttcgccttggccgcctgctcgatcgggtcgaccgcggacttgtcctcgagcgcctcgtggtcggggtgccggaagccggcgttctcgtccagggtgaccttggcgtccagcgccagcacccggccgtcgccgaccttggccagcgggttgacctcgaccagcagcgcgtcctcggcgacgaacgcctgccacagcttcaccgcgatgtcgaccacctggtcggcgacgtcggccgggaacttggcggcggtgacgatctcgcgcgccttcgcctcgtcgacacccttgctcgcgtcgatcgcgaccttggcgacccgctccgggtcctcctcggcgaccgtctcgatctccatgccgccggcgacgctggcgatgcagaggaaggtgcggttcgcccggtccagcaggtaggagaagtagtactcctccttgatgtcggccgtctcggccagcatcaccttgtggaccgtgtggcccttgatgtccatgcccaggatgtcggtcgcacgggcctccgcctcgtccgcaccgtcagccagcttgacgccgccggccttgccccggccgccgaccttgacctgcgccttgacgacgaccttgccaccgagtcgctcggcgatcgcccgggcctcctgcggggtctcggcgacaccgccgcccagcacgggcagcccgtgccgttcgaacaggtcgcgcccctgatactcgaacaggtccacgtgtctcctttcgctcgcgacgccaagcgccggcaagccgcaccgttgcgtcccgacctgttgtatgcgcggcgcgtcgcagtggcgccgccagcgtgaggaatcgtcggccatccggaaatggccgtcatccgcagactagcgaccgaatcgggccctgtgcccgcgcgggtagacggtgtgcaagaccacacactggagggacgaaatcgcagctccgggacggtcggggcggctgtgtacggcagtggcccccgggaccgctcgcgagagtgttcgaaaaaagtcacgacaccgtgcgtaacccgcgagagaaggccctcgttgagtgtgatgtcggcggggtgctactcgggcccgcggacaagaaagcggccgatgccctgtcggtcgaggggtggcggcggggcatcgcgcatagaggggccggacgtgtgaggggtgcgtccggcctctccctatgctctagagctggccggcgggctgggtcccgacattggcgcgaacccattcgatgatggatgcggttgtggcacccggcgtgaataccttggctacaccgagtgattccaattccgtgatgtcgtcctccggaatgatgccgccaccgaataccacgatgtcggcggcgtcgcgctcggcgagcagttccaccacccggcggaacagcgtcatgtgcgccccggacaggaccgacaggccgaccgcgtcggcgtcctcctgaatcgcggtctcgacgatctgctcgggcgtctggtgcagcccggtgtacacgacctccatgccggcgtcgcggagcgcgcgcgccaccaccttggccccccggtcgtgcccgtccagccccggcttcgcgacgacgaccctgatccgtgcttgcatgccaacccctcttcggtgtccacctgaacgaacggtaacccgccgcggcgggcctcgggtagcagcctgggccaggacacggcccaggaatggttaccccggtcacattactttccgctaaataggagatcacgcacggtcgctaatcccctcctaaggaaagctagccaattcggacaatagctgatcaataccggcgtggaactgtcacgaaaatggcgctgcgacttgtgaccgggctgccgtttcgttaccgtggccacggctctcgcacaggttcaccccaccgcgaggacccggccaacactcgttaaccgcttgacggcgggtttcgagggtgccgccgcaatgccaccgacggagggttgttcgtgcgccagcgcttgtcgtctgagcccgatcgctatcgcggccggcgtcgcgtgcccacccctccacgcagccgctacgccgccgtcggcgcggccgccttcgtcggagccgggatcgtcgccatcggcgccgcgtccaacctgcccgactccaaaacggtcaacccggacgtgctgtccagcctcgaccaggcgcagacccaggtcgccgcggacgccctgcagaaccgcgccggcacccacgcctcccgcagcgagaaccgggacgccgccgccaaggcgacgaccaagctctccgacgacgaggttgccgacgcctacctgctgccgctcgacgactacgagttcaccgccccgttcggtgtccggttcggcaagctgcacgccggcatcgacctggccgcccccgacggcacgccgtacaaggcgatccacgccggcgaggtgaccgcggcgggctacaacggcggctacggctactcgatcaccgtcaagcagagcgacggcaccgaggtcatctacgcccactcccggcgcctgctggtgaaaaagggtgacacggtcaaggccggccaggtgatcggcgaggtcggcaacaccggctactcctacgggacgcacctgcacctggagatccacgtcggcggtacgccggtcgacccgatctccttcctcaagccgcacggggtggacatccagctccagctcgaatccgtgtacgccgcccaggccgcgtccctcgccgcctcctgaggccgcttcccgcgcgacctgcccggccggttgctacctgccctgtccgcttgcttcccgcccggcctcccggctgcttgccaccggcctgtcccgttgcctcccgcccggcctcccgactgcttgccaccggcctgtcccgtcgcctcccgcccggcctccccggttgcgactcggttgaatcggttgccgactccctcagtgcccccggccccgggccgacagaaccgtgacaacagcgatcacggttcgtcgggaggaaccctcgcgtggggcagacagcgacaccgggcagcaccggacggcaccgccaggaacgcctgcaccggcaccgcgcccccgccttcccggccctgttcgccacccgcggccgctccgccgtctcactcaccgcgctgaccgccaccctggccaccgggatcggcgtggccggtgcggccgcctcggccgcccccgtgcaccagcacgccacctccggcgggcacaccgccgcgcacccgtacgccgcgctgccgatcgtcccgccacccggtgacgacgccccggccaagacccacccggagctccagcacaccggcgacgaggtcagcgtgggccgccccgcgcccgatccggtcaagcgggcggaaaagccggtcgccgtggccgcggccaccggcacctgggtcgacccgaacccgaccgcccgggtcacctcctgcttcggcgaacgctggggccgcctgcacgccggcgtcgacctggccgccccggacggcaccccgatcgtcgcggccggcgccggcgtcgtggtccgcgccggcgtcgccgagggctacggcaacgcggtgctgatcgaccacggcaacgggtggctcacccattacggccacctgtcccgcatcacggtggccgtcggccaggtggtgcgggccggcgagcagatcggcaacgagggctcgaccggccactcgaccggtccacacctgcacttcgaggtgcacgagggttactacaagaacccggtcgaacccaccgcctggatgcaccggcacggggtggacatcgccggctgcgacaccttctagatcttttcgatcggggcgtgccgcaggatcagccacatcacctggtcgccgaagtcgatctgggcgcgggcgcccggcccgtgtccctcgaccgctaccacccggcccaggccgtaccgctgatggttgacccggtcgccggcctccaccttcggtgcctgcttgagctcgctggcggtggacagccggctggcgtcgatgccgagccgctcggcgatccgctgcgctttcggggtgccgccggcgaagccgccgccgcgctgccggtcgccgccgccgcggccgcccaccccgcccccggtgccggaccacgacgtgtacgacccgccggtgcgctcccagcggaccagctcggccggcagctcgtcggtgaacctcgacggcgggttgtactgcggctggccccaggccgaccgggtgaccgcccgggacaggtagagccgctgccgggcccgggtgatcccgacgtaggccagccggcgctcctcctccagctcggagttgtcggacatggcgcgcatgtgcgggaagacgccgtcctccagcccggtcaggaagaccaccgggaactccaggcccttggcggtgtgcagtgtcatcagggtgaccacaccctggtggtcggggtcgtcggaggggatctggtcggcgtcggcgaccagcgccacctgctccaggaagccggccagggacgcgaccggcgcctccggatcgtcctcgccggcctgggtctccacccgctcggtgtactcccgggcgacgctgaccagctcctgcaagttctccacccggccctggtcctgcgggtcgaggctctcctccagctcggtgagcaggccggagcgctgcagcaccgcctccagcaccgcctccggcgcttcggtcagcgacatctcccgcaggtcgtcgaggatctgcacgaagtcggcgatgctgttggccgcgcgggtggagatgcccggggcggtccgcgcgtgacgcagtgcctggccgaacgagatccggtcccggttcgacagcgcctcgacgcaggcctcggcgcgatcgccgatcccccgcttcggggtgttcaatacccggcggatgctgaccgtgtcgtcctcgttgacgatcgcgcgcaggtaggccagcgcgtcgcggacctccttacgctcgtagaagcgcaccccgccgaccaccttgtagggcagaccgacccggatgaacacctcctcgaagacgcgggactggttgttggtgcggtagaagacggcgacgtcgccggggcgcacctcgtgccggtcggacagccggtcgatctcccgggccacccagtcggcctcggcgtgctcggtgtccgcgacgtagccgacgatctgctcgccggcgccctggtcgctccagagccgtttcggtttgcgcgaggtgttccggtcgatcaccgcgttggccgcggacaggatggtctgggtggagcggtagttctgctccagcaggatggtgcgggcggacgggtagtcccgctcgaactccaggatgttgcggatcgtggcgccgcggaacgcgtagatcgactggtcggcgtcaccgaccacgcagagctcggacgggtcctgatcgtcgcggccgaccagctcgcggatcagcatgtactgcgcgacgttggtgtcctggtactcgtcgaccagcacgtgccggaagcggcggcggtaggcctcggcgaccagcgggtgcgactggaacaggtgcacggtggccatgatgatgtcgtcgaagtccagcgcgtgcgcctccttgaggcggcgctgatacaactcgtacgcctcggcgacggcccgttcgttcggccccttcgccttggccttgaactcctccgggtcgaccagctcgttcttcaggttcgacacctgggcggccaggccacgcgcggtgtagcgcttcgggtcgagatcgagctcgcgggcgaccatctgcatcagccggcgcgagtcgtccgcgtcgtagatggagaaggtgctcttcagcccggcgtgctcatgctcggcgcgcaggatccggacgcaggccgagtggaacgtcgacacccacatcagccgggcgcgcggaccgatcaggtgggcgacccgctccttcatctcgccggccgccttgttggtgaacgtgatcgcgatgatctcgccggggtgcacgtcccgcgcggccagcaggtaggcgatccggtgggtgaggacccgggtcttgccggagccggcgccggccacgatcagcagggggccgccggcgtgggtcaccgcgtcgcgctgcgggccgttctagctagctagccaccggggccggcggggcggcggcggcagccgtctcgggcagcgggaacagggcgtcatcggaaggttcagaggaaggtcgcatcgcgggagccagtgtatgccgaccccccgacaggaaatcgcaccggaacggcaccgcatcggcgttcagcaatctagttgacacctcgaagcggtggcgccggaaccgccgatccaccaggctgatcacgaggttgaacgtccactgacgatgagggatcgactatcatgacttctccgctgcggcggcgggtggccgttccggccgtcgcgctggccgtcgtcggcgcgctctccacggcgcccgcccagtcggccgccgccgcgccgcccgccgagttcgtcccggtgtccgcgtcgtacggcgcctcacccggcacccccgtggtgaagggccggattctcagctacaacgacttccacggcgcgatcgacccgccgaccggcggcggtgcggtggtcaacgccggcggcaccagcaccccggccggcggtgtggaacacctcgccacctatctgaagaggctgcgcgccgaggcggcggcgcagggccggcagaccatcacggccggcgcgggcgacctgatcggggccagcccgctggtcagcgccgcgttccacgacgagccgacgatcgagctgatgaacacggtcggcctgcaggtgagctcggtcggcaaccacgagttcgacgagggcgtcgccgagctgatccggatgcagcgcggtgggtgccacccggtcgacggctgccaggacggcgacggcttcggcggggcgaaattccactacctcgcggccaacaccatcgacaacaggaccgggctgccgatcctgccgccgatcgacatcaagtacgtgggtggcgtgccggtcggcttcatcggcctcaccctggagggcaccgccggcatcgtgaacccggccggcatcaagaacgtgcacttcaccgacgagatcgtcaccgccaacaggtggagcaacatcctcaagctgttcggggtcaaggcccaggtgctgctcctgcacgagggcggcgcgcaggcgaccgtgacgcccaccgcgggcgtctcggactgcaccggcttcaccggcgcggtggtgccgatcgtggccgggctcaacccggacatcagcatcgtggtctccgggcacacccaccggttctacagctgcaagctgcccaacaaggcgggtaccgacaccgtggtcaccagcgccggcaccaacggtcagctgatcaccgacatcgattactcgctggacaagcggaccgggaagttcaccgagatcaccgcgaagaacgtgatcgtggagaacggcgtcccggacggcaacggcggctggaagaaggacgcgaccggcgtctacctgaagaacccggacaccgtcgacccggccgccaagaaggtcgccgacaagtaccgggtcgcggtggccccgctggccaacaaggtgatcggcaccatctccggtgacatcccgcgcagcaacaacgcggccggcgagagcccgctcggcgacgtgatcgccgacgcccagctcacctacaccaccgcggccacagcgcagatcgcgctgatgaacccgggcggcatccgggccgacctggacgccgaccagtcctccggcggcgaggcgtacggccaggtcacctacggcgaggcgttcaccgtccagccgttcaacaacctggtcaccaccgagccgctcaccggcgcccagctcaaggaggcgctggagcagcagttcgccggctacgccaagcagaccaccaccaagatcctgcaggtctcggccggcttcacctacacctggagcgcgtccgccccgctcggctcgaaggtcagcaatctggcgctgaacggcacgccgatcgacccggccgccacctaccgggtcaccatgaacaacttcctggccaacggcggcgacggcttcaccaacctggtcgtcgacccggccaaggtggtcaccgcgcccggcttcgacatcgacgcgctcaccgcctacctggccaccggcaccgtccagcccggcccggccaaccggatcaccaccaccccctgaccgtcgcggatccggcccggccttcccgccgggccggtcttcgggcagttcaccacccttgcgcggtacgtcgtcagcacccccgccacgcaccattcccaacgttcgggcggtttccttgcggcggcatccgggagcggggcatactcggctcgtgatccagcaggcgcgatttttttactacggccccggaagtccggcagccgtgggtcgcccctgatcgacagacctacttcaagccccgggcttccacggcccggggcttgttgcttcccgggccgggccgtccgggcgatcatccgaggagcacgacatgaccgccgacgtgatgaacccgtccaccgacgccgcccgccccaccacgccaccgtccaccgacgccgcccgccccaccacgccgccgacccccgacgccgccccgcccgcgtccacaccggcggccgcgaccgacaaggcggctgccgcggcgatcgccctggacgcgtcgaccggcgccggccgcccgctggccgccgacgagatccgcgccctgcgcgaacggatcgacgagatcgaccaggccatcatcgacctctggcaggagcgttcccgcctctcccaggaggtcggcaaaacccggatggcctccggcggcacccgcctggtcctcgcccgcgaacgcgagatcgtcgaccgcttccgcgccgccctgggcccggacggcacccaggtcgccctcctcctgctccgctccggccgcggcccgctgtaacctggctccgcttcgctacgcgggcaaaacgcctggtaaccggtgagttgacagccgatttctcgtcgccgcaaaaccggcggcgggaaatcgtctgccaactcaccggcggcgttttacggcggccaaaatcgtcgtgcccgggagcggcgggagcagcgatcagttatgggccggagtgcacgacatctgcttcatgaatttgatctttacctgcgtcggtgaccttgaattggctgcgctgatccgccgacgagcggcaagcagaaggccgggccgaaagatcggcccggcctcgctctgtagcaaccgaagacgccctggcttgctttggtagcagccggaagacgcccaactctatcgatatcggtcagcggcctctgacgacatcccggatttcggcgaagtggcaggcgctggggtgcggggaccgctcgcggatctggaggagcggctcctgctgggcgcagatgtcctgcgccttccagcagcgggtgcggaaacggcatcccgagggcgggttggccggcgagggcacgtcgccctccagcacgatctggtcgcggtggccgcgcaggcgcgggtccgggaccgggacggcggagagcagcgcctgcgtgtacgggtgcgtgggctgctcgtagatcgcctggtcgtggcccgtctcgatgaccttgccgaggtacatgacggcgacccggtcggagatgtgccggacgaccgagaggtcgtgggcgatgaagatgtacgacaggccgaactcgttctgcagccgctccagcaggttgatcacctgggcctggatggacacgtcgagcgccgacaccggctcgtcgcagacgatgatctccggcttgagggcgagcgcccgggcgatgccgatgcgctggcgctggccgccggagaactggtgcgggtagcggttgatgtggtcggggttgaggccgaccgtgtccagcaggtcctgcaccgcgcgctggcggccgcccttcgggaccacgtcggggtggatctcgaacggctcgccgatgatgtcgccgaccgtcatgcgcgggttcagcgacgtgtacgggtcctgcagcaccatctggatgttgcggcgggcccggcgcagtgcggcgcctttcaacctgaccatgtcctcgccgcggacgttgatcgagccggcggtcggggtttccaggccgaccagcagtttcgccagggtcgacttgccgcagccggactcgccgacgacgcccagggtttcgccgcgacgcaggtgcaggtcgacaccgtcgaccgcccggaccgcgccgaccttgctcttgaaaacgatgccctgggtgatcgggaagtgcttgaccaggcccttggcttcgaggacgacgtcactcaccgatgacctcccggaagaagtggcagcgcgccgtgcggtgcggctggaccgaaacctggtacggcggcggtggcgggtcctgacggcaggcgtcccgcgcgtacgcgcaccgggggttgaaggcgcaccccttgggcacgtcggtcagcgccggcggcaggccgcggatgacgctgagctgctgtcccttcatgtcgagccggggaatcgactcgagcagggccttggtgtacgggtgggccggacgcgcgtagatgtcgtagaccggcgcctcctcgacgaccttgcccgcgtacatcaccgagatccggtcggccacgtccgcgaccacgcccatgtcgtgcgtgatcaggatcaggcccatgttgcgctgccgctgcaggtcggcgagcaggcccatgatctgcgcctgcacggtgacatcgagcgccgtggtgggctcgtcggcgatcagcacctccgggtcgagcgccagcgccatggcgatcatgacgcgctgccgcatgccgccggagaactggtgcgggtagtcgtcgacccgggtccgcgcgccggggatcttgacctggtcgagcaggtcgatcgaacggcgcttggcctcggcccgcgagatcccgcggtgcttgcggaacagctcgcccagctggaaaccgaccgtgtagaccgggttcagtgcggagagcgcgtcttggaagatcatcgcgatccggttggcccggaccttgcgccgctggtcctccggcagcttctgcaggtcgacgccgcggtacttgatctggccctgggtgacgtaccccggcggggtgtccaggatgcccatgatcgcctgagcggtcaccgacttgccgcagccggactcgccgaggatcgccagcgtctcgcccggggagagccagaagttggcgccgttgacggccttggccacaccgtagttcgttcggaactcgacgtgcaggtcgttcacttcgagcaggggtgcgcgagggtcgacgcccggtaggacgtccatctgcgccttgatatccgtcacagtgtctcctttggcatgccctcgtggccctcacctgcgaggtagcaggcagccaccgggagctgccgttcggtgcagtcggtcatgccggtgtcaccgcaacttcgggtcgaaagcgtcacgcacggcgtcgccgagcatgatgaaggcgagcacggtcacgccgaggaaggcggccggccacaccaggggccacggctcgatccgggcgaacccgctggcgtcggagatcatgatgccccagctgatggcactgcccttgagcccgaccccgaggaaggacagggtcgcctcgctggagatgttgatgccgagcagcagggtgagcagcacgatgtaggacgcgatggagttcggcagaatgtgccggaagaccagccggcccggggtcgccccgagcatccgggcggccgccacgtagtcctggttcttcgacgagatgaccgcggagcgcatcacccgcgcgcccgacgtccaggccagcaggcccagggtgagggtcaccgccatgatgccgtcactgcccgcaccggcggagagccggcgggacagcacgatgccggcgagcaggaacggcacgcccagcatgatgtcgacgaagcgggacaggatcgcgtccacccagccgccgtagtagccggtggccaggccgaagacgaggccgatgacaccggccagcagagtggagagcacaccgacgatgatcgagttgcgagcaccgtaaacggtcttggcgtagacgttgcagccctggaagtcgaacccgaacggggcaccgctcctcgggcccttgaactggttgggaaggacgcagtaacgcgggtcggcggaggtgaacagcgtcgggaaagccgccatcaccaggatcgccaccaccagcacgacggcgacccagaagatcttgcgcttgcgcagatcgtcccaggcgtcggcggcgaggctgcgcggcttgtccttcttgaccgggccgtgcggaacgttcggctgaccgcccggcgcctcggccgcggtcacggtgttcaggtcactcataacggatcctcgggtcgagggcggcgtacagcaggtcgacgagcaggttgatgaacaggaacaggatcaccaagatgctcacgaaaccgaccacgagcgggccgtcctcggtccggatcgcccgggcgaggttgaagccgaccccggggatgttgaagacgtgctcggtcacgatggcgccggccatcagcgtgcccaggtcgacgccgatcagcgtgatcaccgggatcagcgagttgcgcagcacgtgcacccagatgacccgcatccgggtcaggcccttggcccgcgcggtacggacgtagtcggcgcgcaggttctccacgaccgaggtccgggtgacccgcatctcgggggcgaccacgatgcaggcgagcacgatggccggcaaaagcagttgcgtgaaagtcgcgtcacgtgttgcggtagccgtgaaccagtgcaactgcatagcgaacacgagctggaacagcggcgcgatcaccacgatcggcatggccagcaggatcagggtgagcagcagcgaggagttgtcgaagatgccgccccgcttgatcgcggagtacacgccggcggtgatcgagaagacggcggccatcacgatggcgatcacggcgagccggagggtgaccggccacgcatcggccatcatctggctgatcttccggccggtcagggacatgccgaggtccccggtgagcaggcccttgatgtagtaccagtactgcccgaagaatccttcgtcgagatggtatcgctgagtgagcgccaggcgctgactcgcagtgatcggacgttcgccgaccagcgcctggatggggtcggtctggttggcgaacaccagggcgaagagcaggaaggtggacccgaaaaaggtcaacaccatctgcagtaagcgccgcacgatgtagcggaacatgtgggattagcctcttccgcggaagagcgccggcctcgtgagcacggcgacggggtgagggtgggtaacgcagtggtggcgccacggtttcacattctccgtgacgccaccaccggtcaagcggtcgaaactacttcacgacctcgatcttgctgaggtcgacgcgcgagtacaggtcgacgttcacgttcgagaccttctcggagtggccgaacacgttctgctgcgtgtagatcggcatgaccggcaggtccttgccgaggatgtcctcagccgcctgccacttcttcacggcatcgtccgtggtgggcgccgcagaaccctccttgaccaggttgtcgaaggtcgggttgctgtagccgtagtagttcgaggaaccgcccgtgctgtacagcgggccgaggtagtcctccatcagcgggtagtccatgacccagccgagccggatgaggccgatcggggtcttggcctccgccttcttcagcaggtcggcgaacttcggctcaccgacgccggtgcagttcacacccagggacgccttgatctggttgcacagcgcgtcgatccagggcttgtggccaccgtcggcgttgtacgtgatcttgatgtccttcggaccgttggccgcggtgtagagctccttggccttggtcgggttgtatgtgcagttctcgccacaggtgttgtcgcggtaaccgggaacgaccggggagacgaaggaggtcgccggaacccgggagccgaggaagatctggtcgctgatctcctggcggttgatcgccatggacagcgcctggcggacccggacgtccgagaactccttctcgaaggtcgggaagccgatgtagccgaacccggacatcgggctcttcttgaaccggtcacccaggtcggccgaggccttggccaggctttcgatcgggatggtggtctgcacgtcgacgtggccgtcggtcagatcggcgtactccgcgttgaggtcctggtagaccttccaggtgatgccgtcgatcttcggcaccgcgcccttgtaatcggcgaccttctcgaccacgagctgggagtcgtgctcccacttgcccttcagcttgaaggggccgttgccgatcagggcgtcctcgaagccgtcggccagcttgccctcggaggcccaggcggccttcggcagcggcaggaagcagtcataggccatgaccgtttcccagccggcgaacggcgcgtcgagggtgatggtgaaggtcgagtcgtcgaccttcttcagaccggtcagggtcttcgccttggggtccggcgccttcttcgggccggcgccgtccgggtcgaccgactgcaggtcgccgtaaccggcgatgtgctggaagaaggacgacgcgttctggccgttcggcccgtaggcgccgtagttccacgcgttgatgtagttgtccgaggtgaccggctcaccgttgctgaaggtgtagccggacttcagcttcacggtccaggtggtgttggtcttgtcgggcgtgatcgactcggcggcgaccagggtcggctcgttcttgtcgtcgaatttgaccagcggggtgaacagcgactgcagaacctcggagccgctcgagtccgtggtgttcgacggaatcaggtgctccggctcggagataccgataacgaccgtattcgaagtggtcgactggtcatcagacccgccgccaccgcaaccggcggccaacaaggcgatggcggtcgcaccgaccgccatcttccaagggcttttcccaggcatgggagtgcctccttcaggggcgctcacgaggggttgtgtgagtagctgccactgtgacacaggggcactgaaaccaaagagcgccgttatcaagccgatattagccgtttacgtccgtacgcacgctcaaagatcgttcttttggctgattcggctggtctgagctgcgagtactccctgtagtgcctgaacgtacaccgagcgcagccgatcgtgtgattttcggtgacgctcggtggacataacgtcagacgagtcgccgatcagccgcccaccgtgacaactcgtagcggttgctcatctggagtttgcgcagcacgttggagacatgggtctcgaccgtcttgatcgagatgaacagctccttggcgatctccttgtacgcgtacccccgggccagcagccgcagcacctcgcgctcgcggttggtcagctggtccagctccgggtcggcgaccggcacgtccggccgggaggcgaacgcgtccagcacgaacccggccagccgcgggctgaacaccgcgtcgccgtcggccacccggcgcaccgcggcggccagctcgtccggtgagatcgtcttggtgacgtagccccgggcgccggcccggatcaggccgatcacgtcctcggccgcgtccgacaccgacagcgccaggaacttgacctgcggatgggtgcgccggaccgactccagcacggcccggccgccgccgtccggcatgtgcacgtcgagcagcaccacgtcaggctggatctgaccgatccggctgatcgcctcggccaccgtgctggcctcgccgaccacctcgacgtgccggcccagctcggcgcgcaccccggcgcggaacatcgcgtggtcgtccaccaggaagacggtcagccggccggccgactgcgtcacgggctcggtcatctcgacgactccttaccggcggtcacgctctcccgggagaccgggagcgtgagacgcacctccgtaccgttgccgggggcgctgcggatctccgcgcgcccgccgtggcgctgcatgcgcccgatgatcgaaccacggacgccgtgccgtgtctccgccacaccgcccaggtcgaagccggcgccccggtcccggacgaagacgctcaactcgtccggctccacctcggcgtagagcgacaccgtctgcaccccggcgtgccgggccgcgttgaccagcgcctcacgggccgcggcgaccagggccgccaccttctcgtcgcactgggtgtcgccgaccaccacggtctcgacgctgatcgcgtaggtgtcctccacctcggcggcggcctgctccagcgccgcggagaaccgctcggtcggcgaggcggtcggcttgtagagccagttgcgcaggctgcgctcctgaccccgggccagccgctggacctccttgatgtccgccgagttgcgctggatcagggccagcgtgtgcagcacctggtcgtggatcatcgcggccacctcggcccgctcctgctcgcggatccggccctcgcgctcggcgcgcagctggccgaacgtgcgccagaccagcggggcgaccaccacgccgacgccgagcaggccgaccagcgcgaagatcatgccgttgaagaccgaggagagcgagtcggccggcgagtagatcgcgaccacgccgatcacgccgaccgcgaccagcaccccgccgccgacgaagcgcagcatgaacgagcgccggtccgtctcgccgatgatcgccgccatccagccggacggcgcgttcgcgtcggcccactgctcgcggcggctcgggtcggactggtgccagatcaccccggcgccgaccgcgaccaccgcgatcatccagcccaccgtggtgcccacctggtcgccgaagaccagggtctgcagcagcaccacgcccagcccgatcgcggcgaacgggagcagcgcgcccaggtcgcggcgggccggtttctcgtcgaggcgggcctcctgcggcagcaccgcccagtaggccgcgtagagcagcaggcccagcgcgttgaatccgagcagcacgaccaggctgatccgcacggccagcaccggcacgcccaggtggcgcgccagcccggcggcgacaccggccacgatccggtgctcgcgagggcggtacagccggcggatcggcggcggtgcggcggtagcggtcaccccccgatcgtcacacgtgcggcaagccctggccacggggaagtcccccggtgtcgggcgccgggatctcagggtggcctcagggtcggttcctgaggcggctcgggccgcgtgggccgcaggatcggaagcatgaacgacgaagctgccgaaccccgtaccccgggtaccggtcctgagggcgggccggcaccttccgccaccaccccaccgcaggcgaacgtgccgccgtggctcaccgcggcgcaggccgccttcgcccgccagcagctggtccgcccccgcgagggccgctacatcgccggcgtctgcggcgccctggcccggcgcaccggcaccgacccggtgctgtggcgggtgctgctcgcggtgctcggcgtgctgggcggcgccggggtgctgttctatctgatcggctggctggtcatcccgtccgagggggacaccgcctcgccggtcgagtcactgctcggcaagggtcactccgggatgtcgccgctgagcgtggtggtgctcggcggggccgcactgctgaccttctcgttcgtggtcagtgacggcgcccgggccagcatgctggcggcggccgtgctggtgggtgcgttcctgctgatcaaaagaggcgcgccggccggcaccttcgccgcaccgccggcaccggccgggccgcccgcgtcgcccggcgccgaggagccgacgatggcgttcacctcgccgaccccggccgcaccggccggcgaaccggtgaccccgcccgcgccggcggcgtacgagccgccacgctggaccccgccgacggagtccgggtaccgcccgccgttcgccccgcacggcccgttcgcgagcgccggcgcctacccgccgcccgcgccggccaccccgccgccgccgaaaccgcccaagccgccgaagcagcgctcgatcctgggccggctgacgttcttcgcgatcatcgtggtgatgggcctgctcgcggtgctcgacatggccggagtgaacgtcgcggtgtcggcgtacttcgcggccgctctgaccaccatcggcctgggcctgctggtcggcacctggttcggccgggcccgcggcctgatcttcctggccttcctgaccaccatcggtctgctgatcagcacgggcaccgagcggtggggcagcgagttccgggacagcgtgtaccgtccggccaacctcgccgaggtcgccgactcctacgagttcacgctcggcaacgtcaccctcgacctgcgcggcgtcgacttcaccggcgccgaccaggccaccacggtccggatgagcgtgggccagctccgggtgctgctgccggaccgggtcgacaccaccgcgcaggtgcacgtcggcggccggacggtgctgttcggccaggagtacagcggcgacgacgcctcgtcgcgatcggtcaccgacctcggccgggacggcgccggcggcggcaagctcgccctcgacctgcacctcgaaaccggaaacctggaggtgatccgatgaaaccgcaccggatggacggcgtgtccctcaccttcggcctgatctccctggtgatcgcggcctggtgggcggtctcccaggtggtcaccctgcacctgccggcgctcggctggacggtggccggcggcctgatcctgttcggcgtgatcggtctgctcggggcgatcacttccggacgccgcgagccggtggccccggtcctggccgaggccgtaccggcgtcggtcccgggcgatctgccgcccgaggtgcacgcctcgatcgtccaggagctgatggacgacccggccgcccggttcccccgcgaagaacgtgaaacggataagtgacccacttgccccgcccacggaccggcgtccgagggcggggcaatatgctcgcggaatgacccagtttcccgccgtgtccgccacgcccgtcccggccgtgggagcccgggccgcccgcgccctgaccgccgagttcgcccggcagaacgcggccaccaccgccctgctgatcggtgccgaccatgcctccgccgtggtggccgccgccgtcgaggcgctcctgccgggcgacaccctcgtcctggtggccggtgagcacagcagcgccgacctgctccgcggccacatcaccggcctgggcagctgggtcgccgaccgggtgcgcatcctggagtcgttggacgaggcgcagccggccgacgtggtcatcgtcggggagccgctcaccggcaccgccgacgacacccgcggcctgatcgacaaactcgcgaaatacctgaccgacggcgccgtgctcagcgtcgccaccccggcgggcccgggccgcacgatgggcgccgcggccgagctgttccgccagggttcactcttcggggtcggctccgacctggtggtccgcaaccagccgccgctgcgcgtgcacaagctgcggttcaccccggccgaggtgggcgccgccgcgaccgtcgccccggcctaccggacggccagcgtcccgctgacccgcaccatgcacatcgactcgaacggggtggccgccgccggcatcgcgctcggtctggccgcgctggcccgccggacccggccgaagtcgaagctgtggctgatcccggcgctggccgcggcgccggtcgcggcgttcttccgggacccggagcgggacgtgccgtccgacccggcctcggtcgtggccgccgccgacggcaagatcctgtcggtggagcggatgcacgacgaccggttcggcccgggtgagttcctgcggatcgcggtcttcctgtcggtcttcgacgtgcacgtgaaccggtcgccggtggccgggcgggtcgccgactacttcgtcgaggagggcggcttcgcgaacgccgccaccgcggccgccgagcacaacgtcgcggcgtacacggtgctcgacaccgagcacgggaccgtcgtggtggcgcagcggaccgggctgatcgcccgccggatcgtgcagcgcaccccggtcggcacgctggtggccaagggcgagcggttcgggctgatccggttcggctcacgcaccgacgtctacctgccggcggaccgggcggaggcgctggtcagcgtcgacgagcgggtcgtcggtggcgccacggtgatcgcccgctggaagtagccggacacgaaaaggccgcccctcccggtcggaaggggcggccttttcgacgatcaggcgcgcttggcgcgcacccagaggaccgggccgctgaccaggtaggtcgcgacgaccaggacgaacgtcatcttcggctcgaccagcgcgccgaccaccggcagcagccacagccacggcggcagcttcacgatccgggcgagcttcgcgtacgggaagctggacaccatcgcgaaggccagcagcgcgacgccggccagcagcgccatgccgggcagcggcaggccgatcagcacggcgagcgcgaggaccgccgccgccatcgtggtcgggacgccgcagaagaagcgcccgtccttcggcgagacgttgaagcgggccagccggaccgcggcgcagcccgcgaccagggcgcaggccagcgctgcggccggctgcgggacggtgccgagcagcgaggcgtagaccacgaccggcgcggccaggccgaacgagcacatgtcggcgagcgagtccatctgcgcgccgaacgggctggcgacgccgagcttacgagccagcgcgccgtccaggccgtcgaaggcgacgcaggcgaccaggcagccggcggcccaccggggctggtcggccatggccaggaagatggccagcaggccgagcccgagactgctcagggtgcaggcgttgaccagcgcgaaacgcgcccggcgagccatcgtcggctcgcccggcagcagcgggatggtcgccgggacggactcgtccacggggaaggcggcgggggtgtccaggggaactccgggggcgggaatggtgcggctcagccccggttccggcgaggtgtagagcacctcggcacgggtcgcggtggcggcccggctcgtctcggcggcgcggcgacccacccgaaccagcagggcctgccgggcgagagtcccgccacggcgcaaacggccagcccaacggcggccggcgggacgggggctatccgtcgttcgacgccggcgccaaggggtacgcggcacgtggttcctccatggagatcgtggtcaccggcgtcgtccttgaagccaggcgaaattgcgggttacaccatcgcacagcggcgcggccttggcgagaggccttttggtcgcgctgagctatctctgaaactgctcaacaccggtgccgctccccgtgttcctgtaacgattttagcccgcctcagccagtgcttcccgggccagttcggtcagcggcagcccggcgacctcaccgggggtgaaccaggacgcccggtcggtggatccacctgcggcttcgctgaccaccggagtgaccggttcctccactcttacgcgatatacgacgcgaatcacatgccagtcgagcggaacaccttccggtccgagcgccgccgggtcgtatcgatgaccgacagtcagtaggccgtcgatccggccgcgctgcgaggtctcttcataaagttcacgaagtaaaccttcctcgggggtttcgccgtagtcggtgccgccaccgggaagatgccaggaaccgccgccggggtaaccctgcgtgatccgggccagcaggatccgtccggctggatcagtcaccagcccgtacgccccgaaccgctgcacgcggtcaccacggtgcaccggctcgtcgtcgagcggcaccaccgcgggggcgtcgaaggacaccccgagggcgccggcggtgaacggcagcagtgggcgggcggccacctcggcgggcggcacccactcggccaggtcgctggtgccgccggtctccgggcgcagatcgccgccggtgacggccacgtcgtagaggatccggtcggtgtgctccaccagatcgtcgaacgggaacgcgaccacgtcggcgaccacgccgcgcaccccggtgacggccaccgtcaggccggtctcctcggcgaactcgcggaccacggcgtcggccggcgcctcgccgtggtccaccccgccgccgggcagcgaccagacgcccgggaaggcgctgagatcggagccgcgggtgagcaggaccccgccgtcggcggcccggcacaccccgtacgccgcggttcgtctgatcttcactgtgcctagattagcccggccgcccgcagcgcatcggcggtgacttcggtgagctggtcggcggcgagcgcggcaacctcgcgcagcggcatccagccggcctcggaggtggacccgccgacgtcgtggatcaccacctcggtcggcgcgtcgacgaccacccggtagaacgcgcggaccccgtgccagtcgatcgggtagccctccggcccgagcgaggcggcgtcccggtggctggccaccccgagcagctcgatcagccggccctgctggccggtctcctcgaccagctcacggatcagcgccgggccgggctgctcgccgtagtcggtgccgccgccgggcaggtgccaacagccggcgccgggatacccgggcgcgatccgggtcagcaggagattgtcgtacgggtcggtggcgatcgcgtacgccgcgaaccgctgcgcccggtgcagcccgtccggcccctggtaggcgtagaaggacgggaaggtcggcggcacgtcggggcgcaggtcggccgaggcggccgggagtcccagcgcctccgcggcgaacgggcgcagcttgagccgcgccgcctcctccagggtgtgccagcgcgccaggtcggtggggtggccgacccggtcgatcagggtgccgccgcgcaccgacacggtgtagatcagccggtcggtgtggatggtgacgccacggtgcggcagtgagcgcatgtcggccaggacgtcacgcagcccggtcaccgcgacggagaggccggtctccgccgcggtctcgcggacgacggtgtgattgggatcttcgccgtggtccacggcgccgccgggcagcgaccagatgccgggcgtcccggatttggccgaggcccggaccagaagcacgcggccttcgtcgtcggtcgcgacggcgtaggcggcgatcctgcggagcggttccagtgcgggggtcacgaagcggcattctgcccggattatgttactaatcgagggcgtctgtcgggttcctgacagttgaatcgcgctgcgtaaccgcagctcagggcggatttagccgccctgggcgattgatccactactgggcgtcactcccactcgatggtgcccggcggcttgctcgtgacgtccagcaccacccggttgacctcgcggacctcgttggtgatccggttcgagatcttggcgatcaggtcgtagggcaggcgcgaccagtccgccgtcatcgcgtcctcggaggagaccgggcgcagcaccaccgggtggccgtaggtgcggccgtcaccctgcacgcccacgctgcgcacgtcggccagcagcaccaccgggaactgccacacgtcgcggtcgaggccggccgcggtcagctcctcgcgggcgatcaggtcggcctggcgcagcaggtccagccgttcccggtcgaccgcaccgatgatccggatggccagacccgggccggggaacgggtgccgctgcaccatcgcctcgggcagcccgagctcggcaccgagcgcgcgcacctcgtccttgaacagcgtgcgcaacggctcgatcagcgcgaactgcaggtcgtcggggagcccgccgacgttgtggtgcgacttgatgttcgccgtgccggtgccgccgccggactccaccacgtccgggtagagggtgccctgcaccaggaactcgatgtgccgctcggcgtccaggtcgcgggccgccgcctcgaacgtccggatgaactcgcggccgatgatcttccgcttctgctccgggtcggtgacgtccttgaggtggccgaggaactgctcctcggcgtcgacgacgaccagccggatgccggtggccgcgacgtagtccttctccacctgctcgcgctcgccggcgcgcagcaggccgtggtcgacgaagacgcaggtgagctggtcaccgatggccttgtggaccagggccgcggcgaccgccgagtcgacgccgccggagaggccgcagatgacctgtttgtcccccacgtgctgacggatcagggcgacctggtcctcgatgatgttgcccggggtccaggtgggctcgatgccggcgatgtcgtacaggaagcgcttgagcatctcctggccctgctcggtgtgcgccacctcggggtggaactgcacgccggcacgccgggcggtgaggtcctcgaacgcggcgaccggagcgccgggcgtggacgcggtgaccatgaagccggacggggcgaccgagacgctgtccccgtggctcatccagaccggcaggtcggccggcaggtcgcggagcagcgagccgccctgcgcggtgagcagggtccgcccgtactcccgggagccggtgtgcgcgaccgtgccgccgagcgcctgagccatcgcctggaagccgtagcagatgccgaagaccggcacgtcgctgtcgaacaggccggcgtcgagcgtgggcgcgcccggctcgtagacgctggacgggccgccggacaggatgatcgcggcgggattcttcgccagcatctcggcgaccggcatcgagctcggcacgatctccgagtagacacgggcctcacggacccggcgggcgatcaactgggcgtactgggcgccgaagtcgacgacgaggacgggacgcggggtactcaccccgcgagtttaccgacggccctgcacacggccattgagcaccctcgccgggctgctctagggtcggatcatgcggacaggcaggatcgcgcgagccgtggtggtcgccgtgctcgggatgacggtcgccgcctgccggcactccggcgccgccgccccggccgcgtccacggcgccgatcccggagtcgacgccgagcgccgcgccggcgccctccccgggcgccgacctcaccggcccgctcgatctggtgctggccggcgtcgacacccggatcaccgagcccggctgggagccgcactccgacgcgatcatgctgctgcacgtcgacgccgggctgaagtccgcctacctctactccctcccccgggacctgctcgtccaggtcccggcctatccgaaggccggcttcccgggcggcaggcacaagctcaccgaggcgatggcgttcggctcgcggatccccggtcggaccgccaagaacgtggcgaacggctacgacctgctgacccggacgatcagcgcgtacaccgggatcaggaccttccaggccggcgcgatcctcaacttcggcggcctcgaccggctggtcgacgagttgggcgggatcgacatgacgatcgaccagaaggtgaagtcgcggcaccggcgaccggacggcacactgcgcaagctgagcggccacgactacaccgggccgcaggccgtctacctgcccggtaagcggcacctggtcggctggcaggcgatcgactacgcccggcagcgctacggcctgccgaacggcgactacgaccggcagcgccatcagcggcagatggtcgaggcgatcctcgacaaggcgctcggcgagggcctcagcgacccggcgaaacttcagccggtcatcaccgccctcgggaagacgctggtcacggtcggcggacgacaaccgatcgactacgcgtacgcgttgcgtgacctcaccccgtcctcggtgaccatggttcagctggacggcggcggcgtcggcagtggcagcggctacctgggcgaggcgctgaacgcggaggcccgcggcttcctctccgcggtcgccgcgggcaccattgcggcgtacctgaaagcgcaccccgggatggtcgacaagggatgaacgtaatgtcttgaggcatgagacgacggggtccggtcgccgtgctggcggtcctgctcatcgccggtggctgccggtcctccggggccgcggccttcacggccggtgcgatcggggccggtgacccctacttcccgacgtacggcaacggcggctacgacgtggccggatacgacctggacctgcgctacgacccgggcagcggtcagctgggcggccgggcgacgatcaccgcgaccgccacccagagcctgtcccgcttcgacttcgacctggcccacctgaccgcctcgaagatcaccgtggacggcgccgcggcgaccgccgagacggccggcaacgagctggtcgtcaccccggccaccgggatcccgtccgggcggcggttcaccgtcgtcgtcgagtattccggcgaacccgaccagctggagaacaaggcgctcggcaacggcggctggatccgcaccgccgacggcggcatcgcgctgggccagcccgaatcggccagcacctggtatccggtgaacgaccacccgtcggacaaggccaccttccgcctggcgatgaccgtgccggacggactgcaggtgatcagcaacggggtgcccgggacgacggaccgccacgggggctggaccacctggcactgggccgagtccgcgccgatggccagctacctgtccaccgtggtgatcgggcactaccgggtcaccaccggcacccacgacggcaagccgatgatcgtcgcggtgcccgagtcggtgccggccaccagccccggggccagggcactggcccgcaccggcgagatcgcggatttcctggccgggctgttcgggccgtacccgttcgacgcctacggtggggtgatcgtcaccgacagccggatcgggtacgcgctggagacccagtcccggccggtgtacggcggtgacttcttcaccaaggacgagaacgccggggtggtcgcccacgagctggcccaccagtggttcggcgacagcgtttccctgcgacggtggcaggacatctggctcaacgaggggttcgcgacctacgccgaatggctgtgggccgagcacgacggcggccgcaccgcgcagcaggagttcatcatcgcgtactcgtcgacggactggacccagccgaccggggacccgggcccggcgcacctcttcggatcggcggtctaccagcggggggcgatgacggtttacgccctgcgccggacgatcggcgacgacgccttcctgaagctgctcaccgcgtggcccgccgcccacagggacggcaacggcaccacggagcagttcatcgcccttgccgaacagacgtccggcaaggacctgaaagacttcttccacgcctggctctacggaaccgggaagcccccggccccgtgaagccctactgccggtcgaggaccagggcgaccttctggaactccttgacgtcgcggtagccgcacttggccatcgcgcgacgcaggccgccgaacaggttgagctgaccgtcggcgcggtcggccgggccgtagagcagctgctccagagaaccgtccggctcgccggcgatgcagaaaccaccgcgcggcagggcggggtggctggccgccgagtgccaccaggcgccgccggccggggcgccctcggccagcgacagcggctcgcccagcatcaccgcgtcggcgccgcagccgatcgccttggcgatgtcgccggaggtcgcgatcccgccgtcggcgatcaggtgcacgtaacggccgccggtctcgtccaggtagtcgcggcgggccgcggcggcgtccgcgatcgcggtggccatcggcacccggatgccgagcaccgtgtcggtggtcgaccactcgtccgcgccgaccccgacgatcacgccggccgcaccggtacgcatcaggtgcagggcggtcttgtagtcggtgcagccgccgacgatcaccggcaggtcgaggtcggcgatgaactccttgaggttcagcggctcgtcggtggtcgacacgtgctcggccgagaccagggtgccctggatgaccaacaggtcgacgccggcgtccaggatcaccggggcgagtgccagggtgtgctgcggcgacacccggacggccacggtcacgccgccctcgcggatctgccggacccgctcgccgatcagctccggcttgatcggctcggcatacacctcctgcagccgcttggtggcgtccgcctcctcgtccagcgaggccagctcctcaaggatcttgctggggtcctcgtagcgggtccagaggccctcggcgttgagcacgcccaggccgccgaggcggcccagggcgatcaccgaatccgggctctgggtggcgtccgaggggtgcgcgacgcaggggatcttgaacgggtacgcgtcgagcttccactcggtcgagacgtcgtcgacgtcccgggtccgccggctcggcacgatcgcgatgtcatccaggtggtagccgcgctgggcggtcttaccgaggccgatctccactacgtcacgcatcggggtttcagatcctctatttagcgggagtggtagttgggggcctcgaccgtcatctggatgtcgtgcgggtgggactccttgagacccgccgcagtgatccggatgagctgtccccgctcctgaagatcgggaatggtctccgcgcccacgtagcccatggccgcgcgcagcccgccgatgagctgatgcgccaccctggacagaggaccacgatagggcacctgaccctcgacgccctcgggcaccagcttgtcctcgttcacatcctgctggaaataccggtccttggagtacgacttggcctgaccccgggactgcatcgcgccgagcgagcccatcccccggtacgacttgaactgcttgccgttcatgaagatcagctcgccggggctctcctcggagccggccagcaggctgcccagcatcaccgtgctggccccggccacgatcgccttggcgatgtcgccgctgtactggatgccgccgtcgccgatcaccgggacaccggccggcgcgcacgcccgggccgcctccatgatcgcggttatctgcggcacacccacacccgcgacgatccgggtggtgcagatcgcgcccggcccgacacccaccttgaccgcgtcggcgcccgcctccaccagcgccttggcgcccgcgtaggtcgccacgttgccaccgacgatgtcgaccgccacgtccttcttcagccgggccaccatctccagcacggcccgctggtgcccgtgcgcggtgtccacgatcaccacgtcgacaccggcgtcgaccagggcccgggcccgcttgtaggagtcgtcgccgaccccgaccgcggccgccacccgcagccggccctgcgggtccttggccgcgttggggaactgctcgctcttggtgaagtccttgacggtgatcaggccgcgcaggtgcccgttctcgtcgaccagcggcagcttctccaccttgtgcctggccagcagttcgagcgcctggtccttgccgaccccgaccggggcggtgatcagcggcgccttggtcatcacgtcgcgcaccttggcatccaggtcgctgacgaagcgcatgtcccggttggtgacgatgccgaccagcacgccctgcccgtcgacgaccggggcgccggagatccggtaccgcccgcacagcgcgtcgacctggcgcagcgtgtcgtccggcccgcaggtgatcgggttggtgatcatgccggactcggaacgcttcaccaggtcgacctgggccgcctggtcctccaccgacaggttgcggtgcagcacgccgatgccgccctgccgggccatggcgatcgccatccgcgcctcggtgaccgtgtccatgccggccgagagcagcgggatggagagctccacgttgcgggtcagccgcgtgacggtgttgacccggctgggcaccacgtccgactcacccggctgcagcagcacgtcgtcgaacgtcagaccgaggggaacggtgcgagcgctgtcagtttccacagatcatccctaggcaagaggcggagttcatcatcctacccatcccggacgcggcaccctggcggcggacagaacgtgcgggccagcacactcccccgtggggtgagtacggtatgggggtgcaagaagagccgatcgacccgttcaacggcgaccccgccgacccggcagcggaactcgacgacctccaggaggaggccgagagtgagccgctgtccgaggatgagcggcaggacgtcctggaggacctctccgacctggagatctatcaggccctgctgagcccgaccggcatccgtggtctggtcatcgagtgtgaggactgccacgagccgcactacttcgactgggatctgctccgcggcaacctgcgccacctgttgagcagcggccgcccccgggtgcacgagcccgcctacgaccccgatccggatcactacgtgacttgggagtacgcgcgaggctacgccgatggcgtccacgacaccctgaccgagggcaacgacgagaactagcggtccgtcggtggtcaccggtcgtccagatcaccccacgtcatcggtcgtccaggtcaccccgcgaagatcaagttctttgaagatcgaattcgtttttgccacggtccgcgctgatcactgatcgtcgctcccgcggggacccttccgggcttcgcagggcgctggcgcgcccagaacgcgaaacccgaaagggcgacgtccgcggctggtgacgaccgccagatcaaaaccatattggccaggcggctggcgtgccggccgcgcggtcgccgtcccgatcgggctcgcacacgccgggtctgctttgcggtgaccagccacgggccgtgaagggcgcgatgatcgctctggacgcgcagcggccagatcattgcgcccggcccgcgcgggagcatgcgatctgcaccccgctggacctgcgcatatgaagaccttgaacttgatcttggctggtgagaacggccggcgagggagtcccctcgccggccgtcggcgtcatgccaccaggccggcgcggaagcccgccgccaccgcatgcgcccgatcccgtgcaccgagcttgcggaacaggcgccgcgcgtgcgtcttcaccgtgtcctcggagacgaacaactcccgcccgatctccgcgttgctcttgccgtccgccattccgcgcagcacctgcagctcacgctcggtcagcgtcagccgccgcccggccggcgcaccgtcggccatcgcctcgttgcccggccaggccaccatcggccggccggtcgccgggtcgatcggtgcgtcgccgcgctgcaccgggaccatcggcgagttcggcagcatcgccgggacggccgccgcgttgggcgcgcccatgccgatcccgccgttctggtacgccccgcgggcggcgggcgagttgttgttgcgcattccgccggccaccgtggccggctgcgcgttgccgttgatcggcatgccctgcgggcgcaccggcaacagcaacaggagcagcgccttggcgacgacgctgaccaggtcgtgctcgacgccgcggatcacaccgcgggcgccggcggcgacggccgcggccgccacccgggggtcttccgccccgaagagcaccacctgggcctgcggggcgcgggcgaggacgcgccgggtgaagccgacactgtcgggtcgggtcacggcggtgtcggccaggaccacttcggccggccgttccgccagtcggatcatggcctcggtctcgctgaccgcggtccggacgacgccggtcatgccgagccgggccgcggtcgacgcgacggtttgggccgccagcggggttcggacgcacacgaggacggtacgcacagtgatcctccttctctctcagaggagatcacgcgagggccgcagcattacgcgctttagatggaaaaaacgggaaagaaaggtatgacttgccacctctttgccactgcgcacgcgaagacatcgacgtggtgcgtgtgagccggctactgccggggtacacccgcgtgaggcctgcgtcgggcccccaagtcgaccaatccgcggtgccgcgcggtgaggagggtgttgatgtcgaacgttcgcaggctgcccggcccgatcgccgatctctgggactggcagcgcctggggctctgccgcggccgggacagtgcacagttcttccacccggacggcgagcgggggtcgtcccgcaatcgccgtgaggcgaaagccaagacgatgtgcggcgcgtgcccggtgcgggccgagtgcgccgcccacgccctcgcggtgcgcgagccgtacggggtctggggagggttcagcgaatcggagcggctgcggctgctcgcggtcggctgggaggatctggccgatcgtcacggacgggtcgacctggcccggctcgaggcacgcctcggccggccccacaaatcggccgtgcccgcgcagaggcaggcaccggcggcctgagaccgcccggcgcgcggcatcaccacacgactggcgacacggtcctccccggggggccgtgtcgagtggttcagcggttcttcaaccgcatcggtggacatgcaagccaccgtatgagcgacttgtaatttcgtgtcggaccgaaagtgcggctttcaactagttgacggagaccgtcacacggtgccatccggtggccccgtccggagccggatcggctcgctcggaggtctgcgtggcgccgtccaggtcggtcgcccggacccgcaggacgtgccgcccggaggtcgccgtccaggtgtgcgtccactgccgccaggtgtcgtcggagaccgccggcgccagcgcggccacctcccacggaccgtcgtcgacctgcacctcgaccttggcgatcccgcggtgctgcgcccaggccaccccggcgaccaccaccgggccgggtttgcgggaggcgccgtcgcggggcgtgtcgatccgcgactgggtcttgatcggggcctgcgccgcccagccgcgcggcacccagtaggcatcgaagtcagcgaattgagtgagctcgatctcggtgatccacttgcaggccgagacataaccgtagagtccgggaacgaccatccggaccgggaatccgtggtcgaccggcagcggctcgccgttcatcccgatcgccagcagcgcgtcgcgcccgtcgcgcagcaccgcggtcggcgtgccacacgtccagccgtcggtcgaccgctgcaccgcctggtcggcaccgggcaggggatcggcctcgtcgatcagcgccttgatcggggtgcccagccacagcgcgttgccgatcaggtcgccgcccacctcgttggagacgcaggcaagcgtcacataccgctcgatcatcgggcgtttcagcaggtcggcccaggtgatggtgatcgggttgcggaccatgccgtggatccgcagacgccaggtggccgggtcgacctgcggggtgaccagggcggtgtcgatccggtagaagtcgggattcggcgtcacgtacggcaccgcgccctcgacctgggccccgggcgggacgaccggggtcggctcgccggccgccggcaggcgcagctcgtcccgcgcctgggtggccaccccgcggctggtcagccagcgcccggccagcccgccaccggcggcgaccgcgacgacgatcccggcctgtttgaggaactgccggcgacccgccgcctccgggagggcgccgacccgcagcaggtggcgcagcaccaggaagctcagcccggcaccgagcagcgacggaagcgcggcacccgggccggcgcccggacgggtcaccgcggcggccgcgccgatcaccgcgaacagcgcgatcccggcggcggccagcggccaggagcggcgggccaggacgccgacgccgaacgcgtacagcccgagaaggatcgccgtgccggtgagcagcgcgatcttgtcgtgggtgccgaaaaccgcgatgccgaagtccttgaccggggccgggacgtgatcgaccaccaccccgccgaccgccaccagcggcgccgagcgcgggccggccagcaccgccagcagctcggccaccccgagcgcggccgcggccgccgcaacgccggccagaccggcccgaatcgaatgcctcaccgcgccatcctgcaccgtgaagctgaacgtcacctaccgaggatccgatacaccgcgaacaccacgatcagcgcgatcgcgaagaacgcggcggccaccggcggggccaggagccgcagcgtcaccagcccgatcaggccgaccgcggcgaaactcaggcgccagatccgctcggtgcggcgcgggtcccggggcggcggtgccggcggcgcgggcggatgcgggatccgggccgggtcgcgggccgccatggtgacccgctgctccggccgcaccccggtgtccaacgccgcgaccagcgccggaccaccgtccaccagggtcggctcgacgtgcacctggataccgtcgtggccgatgaaccggcgggcaccgtccggccaggagagcacgccggcgaggccgtcgtaccggacggtgacggtcgacgcgtcgccgaccaggctgattccgtgcgtcccggcgatcagccggtcccccgggcgctccgggtcgagcaggcggtactcggcgccggtcaccgcctcggtggagcactccggcgcggcggtgtacccggcccactcggcggtcgtccgccccggcgtcatcaacaggccgtcggcgaccgcgaggcggccggccaccgcgacgtcggccggggtgacctcgcgcagctcggccagcgcctcgtcgagctgccgcacccggcggccggccagcaggttgaacacctgcgcgggcagccgggcaccggcctcctcggcccgggccaggtcctcgcagcgctggttgaccacggcggtgatctcggccggtgcgaagccgccgtcccgggccacctccagcacctcgacgaacccgcggagcaccgcctcctgcttctccggcagcgcgtcggcggccgcggtgatcaccatcgcgccgtcgccccgcgattcgaagtcggcctgcaccgtgtaggacagtccgctctcctgacgcagcgagcggaacagcgcccgctccagcacgccggccagcaccgccgcggccggttgccggggcaccgcggcgttccaggcgaccacgttctccgggccggcgaagtaggcgggacgacagggcagcgcgttcgacggggccggggccggccggcgttcgccgtgcggcagccgcaggtcgaggccgtccggcacgcccgggccggcgatccacagggccgcgttctccgcggtgaaccagcgggccacccagtcgcgcaggtcgtccggagtgagtccggtcaggccccactccgggaaggccggcatgccgtagtcccgggcgccgtgccgccacagcccgagcgggccggccgggctctcgccgcgaccgttctcctcggtgcgcaggatctccttctccaccgggagccgcgacatcggcagctcgcgcaggccggcgcagaccccgttgaggaaggtgacgatgtccgcctcggcgccctgcatgtggaagtacgtgtactccaccccggtggcgccgttgtagtggtagtcggccaccccgaacgagaacagtgcgagatgctcgatcaggtgcgtgataccccgcttggccagcggctcgtcggcatgcccgacccggaagaccaggccggcgtgcatcggcccggtggccggggcgagcagggcgggaatgccgccgatctcccgttcggtgatcatcagggctgtctccggcgcgggaagcggagcacctcgcggagcgggcggcgctgccggggtggcggctgcgggatctgctcccggaccggcatggtgatccaccggtcggccggcacctgcgcgtcggcctcccgggtcagccgggtaccggcgcgcagcagcgagggctcgacccggaccgtgatcgcgtccggcccgatcagatggcgcgcaccgtccggccagacgagcatcgcggcgcactcgtcgtagcgcaccgtggcggccgtcccgccggccacgtggctcagtcccccggcaccggccaccaggtggtgccgggggtcgttgaccgcccggtgcacccggccggtgaccgccgactcggagcgggtcggcccggcggtgtagcccgcccagccggcaccggtgccggccggggtcatcagcagcccgttgccgtacgccgcggcggccacctcggcgacctgctccggcgtgaccgcgcgcacctcggcgaccgcctcgtccagatccttgagctcgcgcccggccagcaggttgaacgcctgcccgggcagccgcccgccgcgggtgtccgcctcggccaggccgtccgcggtgagccgcaccacggtggccacgtccgccgggtcgatccggccgacccgcatcgcggccagcacgtcggccagcgagccgagcgccgcctcgcgccggcccggcagcgcctcggcatgcgcgacgatccgggcggtgccgccggcccgcggctggtagtcggtgcgcaccgggccggagacggcgtcccgctgccggagctcgcggaccatgtgccgctccagcacgttggcgaagaccgcggcgcgcggcgcccgggtcaccaccgcgtcccaggccagctcgtcgcccgagccctcgaaccaggccggggtgatcggcagcgccgaggacgggaccggcgccggccgtcgctcgcccggcggcaggtgcagtttcagaccggccgggatctgttcgccggcgacccagagggccgcgttctcccgggtgaagtagcgcgcgatccaatcccgcagctgctcggcggtgagcccgtcgagaccccactcgggatagccggcggcgccgaaatcgcgggcgccgtgccgccacagggccagcgggtcgccctgctcccggtgttccctgaggcggtcccggacctgctccagccggtcgaccggcggctcgcgcagggcgtcgcagaccccggtgaggaaggtggtgatctcgtcggcgtcgccgcgcacgtggaagaacgtgtgctcggcgccggtcatcggttggtgctgccgcccggtggcgcccgggccgtccagcaccaggtgctcgaccagccgggtgacgccgcggcggggcagcggctcgtccgccaccccgacccggaagaccaggccggcgtgcatcgggccggtggtcggcgagagcacggccggcaccccgtccacctcgagccgggtgatcatgcggcacctccgtccggcagcgcgcgctcggcgtactggctgatcacggtgaccgggtcgccgaggcaggaccacggccacccggtggccagaccgtccagggcggtgaacagcgaggccaccgcgggcatgtcgtcgagcagcgcgaaggccaccgcgaagacgttcatcacgtgcacccagccgtgcgtacgccggaagtcggcgtgccagaccgagctcttcgcggcgtcgtagagcccggagcgcaccgcgtcggcggccagataggtgcgccgggccgcggtgtcccgcagcgccagccagtgctcgatgtgcacctcggcgatcagcacgtggctcagcgagccgggcggcgcggcctcggcggccgaccgggcgaactcgtgcgcccggtcccagtcaccgccccactgcggacacagctgccgcgcgaacccggactgcccgggcaggaagtgcggatcgattgcggccagccggtcgtagcggcggcgagcctcggactgccccaggccgaggaggcgggcggtgcccagccgggcggcccagacggccggatcgtccggggcgcgggcggccgcgtcgatcagctcgatctcggcggcccgccagcgttcggcggagccggcgaccacggtcagatgccggccgagcagcgccgccgcggtgctgtccgccggatcggcggtgcgcaccccgcgcaggaacccggccacctcggcggcctccgcggcggcgtcgatcaggaagccccgctccaccggctccgccgcgtccagcagggcgcggcaggcggtccagtcccgcgcgtcgagtgcggcccggagttcattgatcttcgggtacgcgacggcgggatccaggacggggtggtgcgggggcatgcgcggcagcatagagcttccggggccgttcgcgcgtcccgggtgatcgggcgttcagctgatcagcgggtcgtcgagcaggtgctcgaaggcgagttcggccgcgccgatcagggcggcgtccgcgccgagctccggggtgcgcagccggacgtgctcccggcaggccggcagcccgaccgagttgagccggctgcggatctgggcggccgcgaccagatagacgtcgcgcagcgtgcccccgaagatcaccacctccgggttgaagatgttgaccaggttgccgacgccgaacccgatccagtcgccgacgtgccgcagcgcgtgctgcgcctggctgtccccgcggaccgcggcgtccaccacctccagcaccacgtcgcgtccggtgcggtcggcccggccggacagccgcagcagcgcgtgttcgccgatctcggtctcccagcagccgcgggaaccgcaatcgcagggccggccgtacgggttgaccaccatgtggccgacctcgccgccgtacccgccgtgcccggtgacccgccgtccgccggccacgatgcccgcgccgacgccgacatcgccgtacaggtagatgacgttgtcgcagccgaccgccgcgccgcgcgcgtgttcggcgagcgcgcagacgtccgcgtggttgccgatgctgagccgcccgggtgcgccgagctcggaccgcagcgcggcgccgaccggctcctccacccagccgatggtcggcgccagccggaccatgccgtcctcgcggcgcaccatgccggccaccgcgagaccgctgcccacgcagcgggcgtcgtcgctcacctggtcgtgcatcgcccggacgaaccgggccagcggctcgaccgcctcgtccgcgctcatcccgggcggccggacggtctcgtactgctccaggatctgcccgcccagcccgacccgggcggcgcgcagccgatccacctcgatgctgagcgagtacgcgaagaccgtgtccgactcgggccggacgaccagtgacggccgtccggcccggccggtctccttcggcaccgcctcgctgaccagaccagcgctgatcagctcggcggtgagtgccccgatggtgctgcggttgaggccgagccgggtggtgagttccgcccgggaggtggcgccgtgcatgtgcacgtaccgcaacagcgtcccgagattgtggcggcgaacctcttcctggctggggccggcgcgcatcagctcgccgacccccgcccccggctccgactcaccggttgcccgaggcggccgccctgcggcgggccagcgcgtcgacgctcgcggcgagcagcaggatcagaccggtgaagatgtacttggtgcccggctggtaccccatcaggcccatgccgttgtcgatcaccgcgatcaccgcgccaccgatcaccgcgttgatcaccctgcccttgccaccgaagaggctggtgccgccgatcaccgcggcgcccaccgcgtacagcaggatgttgctgccgccggtgttcgggtcgaccgaggtggcccggctgaccagcatgatgccgccgatcgaggccatgaacgagcagatcacgaagaccgagatgcggatcccgtcgaccgggatgccggcgcggcgggccgcctcggtgttgccaccgaccgcgtagacgtgccggccgtaggtggtgcggcccagcacgaacgtccagatgacgaggaacgccacgatgatcgggacgacgatcggcacgcccttgagcgagttgagcgccgggttgatcgcccgctcctgggtgagcaccgcggtggcgatcagcacgatggccgccaggccgccgacgcgcagcagcacgatgccgatcggctcggtgatcaggccgcgcttggcccgcgcccggacccggttcagctgcaccgcggcgaacaccacgaccgccaggacggcgaagccccagctcagaccgatcgagaggttgtcgttgttgaggctgttgacgaactcgtcacgggtcgagatgttcttgccctcgccgagcagcttcagcagcacgccctggaaggccaggaaggcggccagggtgacgacgaacgacgggatcttgaccttggcgaccagcgagccgaggagcaggccgatcacgacgccggtgagcatcgcggccgggatcgccaggtaggccggctgcccgtgctcggtcagcatgatcgccatgatcgcgccgcagacgccgctggtgtaaccggcggacaggtcgatctcgcccagcagcaggacgaagaccaggcccatcgcgatgaagatgacgccggcgccctggttgaacaggttggcgaagttgcggccgctcaggaacgtgtcgctgcgggccacgccgaagaccagggagaggacgatcaggccgagcacggccggcagggtgccgaggtcgccaccgcgcacccgggcccagtagtcgcggatgtggctgctgaccgtcggcttgacggcctggatgccacccgccgtggtggtggtcgtggtggtcactgctcttctcccggcgtgatgtcgacgaagtcggagggcttctcgggcggcagaccgaggttgccgctgcgcccggcggtgatcagctcgacgacctgggagtgcgtcacatcggagctcttcacctgggcggccatccggccgaggtagagggcggcgatccggtccgacacggcgaagacgtcgttcatgttgtgcgagatcagcacgacgccgagaccgttgtcggccagccggcggaccagctcgagcacctgcgcggtctgcgccacgccgagggccgcggtcggctcgtcgaggatgacgaccttgctgttccagagcacggccttggcgatcgccacggtctgccgctgaccgccggagaggctggcgaccagctggcgcagcgacttgacggtgcgtaccgagaggctgcgcagcgtctcgccggccatctcctccatggtcgcctcgtcgaggacgacgccgcgcttcttctcccggccgaggaacatgttctggacgatgtccaggttgtcgcagagcgcgaggtcctggtagacgacctcgatgcccagagccgacgcgtcccgggggctgtggatggcgacctctttgccgtcgaagacggccgtgcccgagtcgatgttgtagataccgctgatgcacttgaccagggtggacttaccggcgccgttgtcgccgaccagggcggtgacctcgcccgggtagacgttgagtccgacgtcgtgcaggacctggacgggaccgaagctcttgttgatcccgcgcagttccagtaggggtgtcgcggccacggatggttctccttcgctcggtgaccggttggatcgcgcgcctgacgcccctcgacactgagaggcagcgaaaccgactccggcgccgcccacctcaaggtgggcggcgccgtcctcagccgtcaaacggtgggggctggttcagccgatggtcagctgatgccagcgtcggtgcaggccttggcgaagtccgcggtgcagagctcctccttggtcacgaagccgtccgccacgacgtccttgacgttcgccttggtgatcgactgcgggtcgagcaggaccgacttgacgtccttcttcgactccgggtcggtgacgctgccggtcgccgtggtcggcgcctggcccttggccagcgagatggccagcgcggaggccgcgtcggcctccttcttgatcgccttgtagaccgtcatgcactggtcgccggcgaggatgttctgcagaccctggacggtggcgtcctggccggtcaccgggacctggccgttcagcttgttcttcttcagcaccgagatcgccgcgttgccgagaccgtcgttggcggccagcacacccttgatgttcttgttgctggtcagcatctgctcgaagatggtgccgccctgggcgttgtcccagtccggaacgctctggtccgggcccttgacgtagtcgcccgagtcgtacttcggcttgagcaccgagtcgtagccctgcttgaacagcgtggcgttgttgtcggtcggcgagccgttgagctcggcgatgaccggcttggtgaccttggccgcggtcaggcagtcgaccaggccctggccctgcagctggccgaccttggtgttgtcgaaggacacgtagaagtccgcgccaccgttgagggtcagacggtcgtagtcgatcgtcgcgatacccgcgtccttggccttcttcagcaccgcggcaccggaacccgagtccaggttgacgatgaccaggaccttgacgcccttcgagatcatgccgtcggcgatgctcgcgaactgggtcttgtcgccctgcgcgttctggatgtcggcgtcgacgccggccgccttgaacgcgtcggtcaggtacttgaggtccgcggtcgcccagcgagccgagctcttggtgtcggggaggatgacgccgaccttgcccgccgaagcggcgttgctgccgcccgagctcggggtcgtgtcgtccttcttgtcgccacaggcggccatgcttccggtggccagcaggccgaccgcggcaagggcgaacagtcccttacgcattccgtatgtcctttcggggggtaaatccgggccttcgttcggatttttcaggggtggtgcgtgcctgggagtgtcgctcccctgggcgccgatggatcaggaaccggtttgttgtgcccggcaacgtattccgacggtggcctggaacacaagccactgcggagatctatctcgtaacgctggataacaatcccgcaacacggccgggccggaaccggtacgacctgccccggaaagtggcgttccccaacgcatgacgtaacgctaagtaagaatcggccgcgagggagccggatccggcaaggtcggccggacaaacctgacggtcatcgcacggcgccggcgggacgagccgtcacgcccggatggccgcgacggtggcgctggtcaaccggaccaggtcggccggcgccaggctcacctgcagaccgcggcggccggccgagacgtacatcggctccgcaccgaacgccgagtcgtcgatcactgtgggcagtcgcctgcgctgacccagtggactgatcccgccgcggacgtagccggtgctgcgctcggccgtcgcccggtcggccagcgccgcccgtttcccgcccgccgcgtgcgccagcgccttcaggtcgagctcgccggtgaccggcaccacaccgaccaccagggcaccgtccacctcggccaccagcgtcttgaacacccgctccggcgccacgcccagagccgccgcgaccagggcgccgtagttcggcgcgtccggcgacacctggtacgggtgcagggtgtgcgccacccgctgcgcggtcagcagcacagtggccggggtgccggccgccctcttcggcatgaccgcacgctacccccgagccctcaggagtgctcggtcagcaacaccgtgggggcaccgtccacccgggtcaggaccaagcccgcggcctgcggcccggacagtttcagatccttgcgcaactgatccggtacgagcgccgaaccccgcttgcggatctccagggtgcccaccccgcggtcgcgcaacagcgcgcgcagccgcttcagcgagaacggcagcacgtcggtcaccgccagccgccgggcgaacggggtgtccaccgggtcgtcggtgtagacgtaggcgatctccgggtcacccagccgcccgccgatccgctcggcgaactcggccaccaggtgcgaccggaccaccgccggatcggggtcgtagaaccacgcgccgaccgggccgaccggggcccgccggtcccccgtgccggtgagctcgccgaccccggccagggtcgcccggcgcggcacggcggccagcggaccgcaccagaaggccgcctccaccaggtcgccgccgacactcacccactcgccctcggcgcccggcggcagcagcccgtggtcgatccccggggccagcttgagcaccgtgcgggggacccggccggccagtccggcgacgaagtcccagggcggcgaatacgacttcgggtcgaacacccggccgcggccgctctgccggcgggccggatcggcgaagaccgcgtcgaacctctccaccgtgacggtggtggcgtcggcgcaggtcacggtgatccggtcggccaggccggcggcgtgcgcattcgccgcggcgagggcggcggtggccgggtcggcgtccaccgcgtacaccgtgatcccgtgccgcgcggcggcgagcgcgtcggcgccgaggccgcaaccgagatcggcgaggctggtgacgccggccgccaccagccgggccgcccggcgatccgcgaccaccgcccgggtggcctgctccaggccgtgccgggtgaagaacattccggcggcgtccgggccgaatttcatcgccgcccggcggcgcaaactagcctgggtgagtgcggctgcggccagctccgcgccgaagccccgggcccgcagggccgaggccgcggcgagcggctcgccgtcgcccatcccggtcgccacggccagggcctgctcaccttccggggtctgcagcagagcaaggagttcaggggtcacaccaggcattctccccggcgtgacaggttggcactctggttgacggagtgctagttccggcataatctccggttagcactctcaacatgagggtgccagccgccccggccctgccgaggtggctaggcaccaggcggaccggcacccgcgacgacggccccgcccggtggcatgaggcattgaccggcctggctcatggccggcgaaacctgtacccaggagggtatgcccgtgactaccgcgaccaaggttgcgatcaagccgctcgaggaccgcatcgtggtccaggccaacgaggcggagaccaccacggcgtcgggcatcgtgatccccgacaccgcgaaggagaagccgcaggagggcaccgtcctcgccgtcggccccggccggatcgacgacaagggcaaccgcgtcccgctcgacgtcaaggtcggcgacgtggtcctgtactcgaagtacggcggcaccgaggtcaagtacgccggtgaggagtacctggtgctctccgcccgcgacgtcctcgcggtcatcgagaagtaaagacctgactgactgcgcagacgccctgttccggatcttcggggcagggcgtcggtgcgtgaagggaccactacatggcgaagatcctcagcttctctgacgacgcccggcacctcctggagcacggcgtcaacacgctcgccgacacggtcaaggtcactctcggcccgcgcggccgcaacgtcgtcctggacaagaagttcggcgctccgacgatcaccaacgacggcgtgaccatcgccaaggagatcgagctcaccgacccgtacgagaacctcggcgcccagctggtcaaggaggtggcgaccaagaccaacgacgtcgccggcgacgggaccaccacggcgaccgtgctcgcccaggcgctggtccgcgagggcctgcgcaacgtcaccgcgggcgccaacccgatcggcctcaagcgcggcatggacctggccgccgaggtcgtctccaaggcgctgctggccaaggccgtcgaggtcgccgaccacaaggcgatcgcgaacgtggccaccatctcggcccaggacgccaccatcggtgagctgatcgccgaggcgatggaccgggtcggccgcgacggcgtgatcaccgtggaggagggctcggcgctgcacaccgagctcgacgtcaccgagggtctgcagttcgacaagggcttcatctccccgaacttcgtgaccgacgccgagtcgcaggaggcggtgctggaggacgcgcacatcctcctcaccacccagaagatctccagcatcgaggagctgctcccgctcctggagaaggtgctgcagaccggcaagccgctgctcatcgtggccgaggacgtcgagggccaggccctgtccaccctggtggtcaactcgctgcgcaagaccatcaaggtcgccgcggtgaaggcgcccggtttcggtgaccgccgcaaggcgatcctgcaggacctggcgatcgcgaccggtggcgagctgatcgcccccgagctcggctacaagctcgaccaggtcggcgtcgagcagctgggcagcgcccggcggatcgtcgtcgacaaggagaacaccacgatcgtcgacggcggcggcaactccgccgacatcgccgaccgggtcgcgcagatccgcaaggagatcgaggcctcggactccgactgggaccgcgagaagctctcggagcggctggccaagctctccggcggcatcgcggtgatcaaggtcggcgccgcgaccgaggtcgagatgaaggagcgcaagcaccgcatcgaggacgccatcgcggcgaccaaggcggccgtcgaggagggcaccgtcccgggcggcggcgccgccctcgcgcaggtcgccacggagctcgacggtggtctggggctgaccggcgaggaggcgatcggcgtctcgatcgtccgcaaggcgctggtcgagccgctgcgctggatcgcgcagaacgccggccacgacggttacgtcgtggtggccaaggtcgccgagctgggctggggccacggcctcaacgcggccaccgaccagtacgtggacctggccgcggccggcatcatcgacccggtgaaggtgacccgcaacgcggtctccaacgccgtctcgatcgccgcgctgctgctgaccaccgagagcctcgtcgtggagaagccggccgagccggccccggcggctgccggcgggcacagccacggtcacgggcacggccaccagcacggtcccggcttctgatcggttgcactagaagggcgcgtcctggcgggggcgcgcccttgccatgtccggaggcttctccggggcttcgccaccgccctgccaggagcgccacagggcggcgtacgacccgttcgccgccaccaggtcggcatgcgagcccaactcggtgatccggccgtcctccaccaccgccacccggtcggcgtcgtgggcggagaacaggcggtgcgcgatcgccaccacggtccgcccgtgcaccacggccgccagcgaccgttccagatcacgggccgcccccgggtccagcagcgccgtggcctcgtccagcaccagcgtgtgcgggccggccaggaccagccgggccagcgccacctgctgcgcctgggccgcggtcagcacctgcccgccgtctccgacctcggtgtccagcccgtgcggcagcgcgtcgacccactccagggcatgcacggcggcaagcgcggtgcgcacgtccggttccggcgcgtccggccgggccatcgccacattgtcgcgcagcgtcccgatgaagatgtgatgctcctgactgaccagcgccacctcggtgcgcagccggtccggggcgagcgcacccagcggcacgccaccgaccgtgacactgccggcggtcggctggtgcagcccggccagcagccggccgagcgtggatttgccggcgccggacgggcccaccacggccagccgctcccccggccgcaacgtcaggtcgacaccgtgcagcacctcacggcccgccacgtagccgaagcgcaggccgcgcacctcgatccggggaccgtccgggaccggggcggccggccggggcggctcggcggtcgcggtcaccccgagcagccgggccagcgaggccgcgcccacctgcagctcgtccagccaggagagcagccggtcgagggggtggatcagctgctggacgtagacgacggccgcggtcagctggcccaggccgaccgttccgcgcagatagagccagcccccggtgagcagggtcagcaccatcggcagcacgtagctgacctcgatcaccggccaccacacggtgcgcaggaaaagcgtgtaccgctcggcccgccaggaccggtgcagatcccggtcggtacgcgcgatccgctgcccctgccggccgagcgcctccaccgtgcgggcgccctcgaccgtctcggccagcccgtcggtgacgtccgagtacgccgcgttctgccgcagatagccggccggggcgcgccgcacgtaccaccgcgtgccggccaccgtgatcggcaccccgatcagcagcggcaacgccagcaccggcgacaccgcgaccagcgcgaccaccaccagcccaccggtgagcagcgcgatcgtggtctccggcacggccagccggacacatttggagagcgcgtccacgtcccgggtggtacgggtcagcaggtccccggtgccggccgactcgaccgtgcccagcggcagggacagcgcccgggcgatgaactcctcccggagccgggccagcacctgctcgccgagccgggccgaagccaggtaggcatagcgcaccagcaccgcctgcaccagcacgaaaccggccagggtggcggccagccggttcagctcggcctcgtgcaccccgcgctgcaccccctgcaccagctcgccgagcaggcgcgggccggccagcccggcgcacgcggcgagcaggtgcagcccgaccgtggcccggaacatgccggggtggctgcggaacagggatcgggcgtaccgccaggcctgcgcgcggccggccaccggaagcggacggctcacgacagctcctcgcgcagcaccacacgggcgtagccgggctcggcggcgagcagctccggatgcgccccggcagcggtcacccggccgcactccacgaagaacacccggtcggtgtgcgccagcaccagcgggctggaggtgcagacgaccgtggtgcggccggcccgtacggcgcgcagccgctcggcgatccgggcctcggtgtgcgcgtcgaccgcgttggtcggctcgaccaggatcaggaattccgggtcggcgaccagcgcccgggccagccgcagccgttgctgctgaccgccggagaacgaccggccgcgctcggcgaccacactgtccagaccgcccggcagaccgtccacgatgtcctgtgccgacgccgccgcgagcgcctcggccagccgcggggtccggtgcggatcgaggtcggcgcgcagccgcccggagaacagccgcgcctcgttctccaccaccaggatccgctcccgcaccacctccagcgggatcgcggtcagcggtgtgccgtcccaggtggccccgggcgcgtaccggccgagccggtcggcgatccgggcggtgtcggccggatcctcggccacgatcgcggtgagccggccgggcatgaccagcaccccggagagggggtcggccagttcgccgccgggcggcggtaccgtcaccggcggcttcgccggcggatcgggcaggtcacggcgcaggccgagcatgtcggcgacccggcgggccgagacgtgcccgcgggtcagtttgtcgatcgagtcggtgagctgccgcagcggcgagaccaggaaggcggcgtacgcgtagaacgacaccaactggccgatcgagatccggtgctcggccgcgaaccgggcccccagccaggtgatcagcaccagcaacgtcccgggcagcagcacctgggcggcctccagcagcgactccacctcggcggtgcgcaccccggccacccgcagcgcctgcgaccgctgccggtaccgcgccaccatgaccgcctcgccgcccaccccgcgcagcacccgcaacccggtcaccaggtcggcggcctgcccggtgagccggccctgccgctcccggtaggtctgctgacgcgcgtgcagcgggccgatcagtccacctacgacgatcatcagggccggcaccccgatcagcaccaccaggccgagcgggaccgaggtgcgcagcagcagcacggtgaccgtgccgaccgcgaccagcgccccggcgccccgggccgcgacgtccaccgcgccgccgatgtggttgatgtccgaggtgccgatcgccaccacctcgccggcctccagccgccgcggcagcgacgagccgagccggttcgcctgccggacggtgacctgcaccgtccggaaaccggcaccgagccagttgaccaccgagaaccggtgccggctgataccggcgacggcctgcgccaccccggccgcgaagagcaccagcccccagccgagcaacgcccggccacggcgttcggcggccgcgtcgatcgcctcaccgacgatcgccggcaccagcgactggcaccccatccaggcgatcgccagcgcgatcgcagtgagcatcgtcatacgggagcgccggatcagccagctcaggtaacgcgtggcggaccgggcgtcgggcaggccgggatcggccacgggcagtctgcgcatcaggccccgacggtacggccgggaacgcccgtgctgcgaccgctcagcgatcgacgggggtgaaatcccagacgtgcggagcgcgtgccaccagcttctccggcgggctgggcaggctctccggggtgtttcgccatttggagatgacgacgatgcgatgatccgtggacgaatagacgtcactcgacacatgttgtggcagcacctcgaggctgggcaccgccgtgtcgcagacccagctcagcagctcatcgaagccgctgcgcgaggcccgcacctcccacatccgcgcgatcatgttcgcttcctaccccgcgacgctgaccgcggtcaaacccatcgcggaatccgccggaaggtcgagacgactcggcgcgacgccggcggccaccagatgcgagccgagcgccgcgaccatcgcgccgttgtccgtgcacaactgcggccgtggtacgcgtaccgcgatcccgtgccgggccgcccgctgctccgccagcacccgcaaccgcgagttggccgccacacccccgccgatcaccagggtgcccaccccgtgctcccggcaggcatcgatcgccttggcggtcagcacgtcgcagacggcctcctggaagctggccgcgacgtcggccaccgggaccggctcgccggcccgctcgcgcgcctccacccagcgggccaccgccgtcttcagcccggagaaggagaagtcgaagcggtgcgcggccaggtccttggcggcggtcagcccgcgcgggaaggcgatcgcgccggcgtcaccgtcccgtgccgaccggtcgatgatcgggccgcccgggaagcccagcccgagcagccgggccaccttgtcgaacgcctcgccggccgcgtcgtcgatggtcgcccccagcggggtcaccccggccgtcaggtcgtcgaccagcagcagcgacgagtggccgccggagaccagcatggcgatcgccggctcgggcagcgggccgtgctccagagtgtccaccgcgacgtgcgcggccagatggttcacgccgtagatcggcttctccgcggccagtgcgtatcccttggcggcggccaccccgaccagcagcgcgccggccaggccggggccgctggtgaccgcgatcgcgtcgacgtcggccagcgtgacaccggcctcgtccagcgcccgccgcatggtggggaccagcgcctccaggtgggcgcggctggccacctcggggaccacgccgccgaaccgggcgtgctggtccacactggacgccagtgcgtcggcgagcagggtgtggccgcgcacgatgccgacaccggtctcgtcgcaggaggtctcgatcccgaggaccaggggctcgtcacgcatctcgcatcatcaccagggcgtcggtgttgctcggttggtagtagccgcgccggatgccgaccggctcgaaatcgtaggtggcgtacagcttctgtgccggatggttgtcgacggccacctcgagcagggtgcggccgacgccccggcgggccgcctcggcgagcagatcctccagcagggcgcggccgatgccgccgcgctgggcatcccggcggaccgcgatgttctgcacccaggactcctcccggtccaccacggacaaaccggcataaccggctatgtcatcgttttccagggcaacgatgtagtagttccgctgcgccagctcattccagaacatggcggcggaccacttctccggcccgaagagatcctcctccagcgggaggatcgcctcgatgtgccaccagcggagtcgctcgatgcgcatcaggtcagcaccggcttgcgaccggccggctcgacggcgtccggacgccgcagatagagcggggtgaggatctcgctcgcggccccggcccggacccggtcggccgcgagggccaccagcgcggcacccggcgggtagagcaggtgctcctccaccggcagcccgaagacgtccccgtacttcaacgccccctcgcccgccgccctgtccgcgttcaccgtgacatcggcgggcttggagacatcgggaccaccattgcgtacgccgtcgacgtacgacgcgaaatacacctcgcgccgccgcgcatcggtggcgatcagcacccgccccggcccggccgcccgccccagcgcgtccagcgaacacaccccgtacgtcgggatgcccagcgcctgccccatcgccgcggccgtggccagccccacccgcaggccggtgaacggccccgggcccaggccggccacgatcgcggtcagatccgatggtcgcaccccggccgtggcgagcaccgcggcgatctccggcgccagtttctcgccgtgcgcccgggggtcgaccgtgcgactttccgccaccccgaacaaaccgtctgcggtgacctcgacgagcgccgccgtcgaggcgggcgttgcggtgtccagagcgagtacgagcacggtgaaaaccctagacggtggcccgcgggtcccagttcaccaccggccggccgccgtcggcgagtgccttgttggcggcgctgaacgggcggctgccgagaaacccggcggggttcatcgggctcgggtggccggcctcgatcaccgcgtgcaccgggttggtgaccagcgccgccttcttcttcgcgtagttgccccagagcaggaagacgacccgctcgttgcgctcgttcaacgcccggatggtggcgtcggtgaacgtctcccagcccttgttggcgtgcgaggcggccttgccggcccggaccgtgagcaccgcgttgagcagcagcaccccctgccgcgcccagccggtcaggtcgccgctcttcggcggggcgatgttgacgtcctcggcgagctccttgaagacgttgcgcagcgacgggggcacccggaccccctcgcggacgctgaagctcagcccgtgcgcctggccggcgccgtgatacgggtcctggccgaggatcagcacccgggtctgctccggcgagcacagccggtacgccgcgaacaggtcctccgccggggggtagacggtgtgctcggcgtactccgcggcgacgaactcgcccagctcggccgtcgcctgcgcatccaggaagggggccagctcggcgcgccactcggcggggaggtgctcggtcaggttcacatctgctccagtcggtgtgcccagtcgccgccgtgcggcgtcagctcgatcactcgggtgtcgtcgtccagccgctcgaggcggacgaggagatgttcgtcgttcagttgctcgaccagaccggcgccccattccaccacggtgaccgcctcgtcggcggaggcgtccaggtccaggtcgtcgatctcggcgcgcgggtcggggcggtcgcccagccgatacgcgtcggcgtgcaccatcggcaccgggccgcggtgcacccgggcgatcacgaaggtcggcgaggtgatcggcccctgcacgcccagcccggtgccgatgccctgggccagcgccgtcttgccggcccccagcggcccggtgagcagcaccaggtcccccgggcgcagcacggcggcgagccggcggccgaaggcccgggtctgctcgacggtggtcagcttcacgagatcttctccaggaacgggatcagggccgcgttcacctcgtcggccttctccagcatgaccacgtgcccgctgttctcgatcttcagcagctcggcctgcggaagctcgcggatgatctgctcggagtgggtgaccggggtgaggtagtcccggtcgccgacgacgaccagcaccgggacgccgcgcagcgcggacagcgccggcagccggctgtggcgatacagcgtgttcaggtatttggtgagggtctccaccgaggtccgcgaattcatgctctccacgaaggtgaccagcgacgggctgggccgggcctccccgaacccgtaccgccgggtgagcagccaggccaggtcggaggaggccacccgggcccggtcgatggtgccaccgcccagcttggccgcccgatcccagagcgggaagaacggcgcgctggcccgggccaccacgttggtcaggccgagggtcgccttgtcgaacagcccggccgaggtggacatcagcaccacgccggtcacccggttgccgaaccactccgggaactgctcggcgaacgccatgatcgtcatgccgcccatcgagtgcccgaccaggatgatgtgcccgtccgggacggtcgcgtcgagcacggcggccagcgaacggcccagggcggcgatgtcatacgccccggactgcagcctgctggaacggccgtggccgggctggtcgtagaagaccaggcggtggtcgccgcgctcggccagcgccttgcgctggaagtagaaggtgcccatgtccagcgcgaaaccgtgcacgaagacgatggtgggtttctccttccggccgcgcccgggccggccggtccagccgcggggctcctcggcccgcggatcgacgatctccacgtgcagctcggtgccgtccgccgcggtgacggtgcgctcctcgtcatagggctgatcgccgaacggctcgtcgacatagggatcaccgggcttgttgaccgagcgccggaccaacacccgctccacggcgaacgcggtcgccagaccggccgccgccaccccgacgaccgccccggctatcccggccgtcttggccgcacgggaccggctcacgcgacctccccggtgtagacccgcggcacccgcccgctgccgaaccgggtgacgatctcgtagttgatcgtgccggccgccgccgcccagtcgtccgcggtggggccgccgtcgtcacccgccccgaagagcgtcgccacgtcaccgggcgccaccggggcgtcacccaggtcgaccacgaactgatccatgcagacccgcccggcgatccgcgcggtggtcgtgccgatccgcaccgggccggcgctggatgcgtgccgcggcaccccgtcgccgtagcccagcgggaccacggccagggtggtctcccgctcggtgtgataggtcaacccgtaggacacgccctgcccgcccggcacccgcttggtcatcgtcacccgggcgcgggccgtcatggccggacgcaggccgtaggtctcgcccgcgatcggcgacaacccgtacgccgcgatgccgacccggaccaggtcgaagtgcgtgtcgggacgggtcagcgtggccgccgagttggcgatgtgccggtagcgcggggtcaacccgaaccgctccgccacggccaggccgtcggtgaacgcggccagctggcggtcgaccgactcgtggcccggctcgtcggcacaggcgaagtggctccacaccccggtcacctcgacgtccccgccggcctgcgccttggccgccgcctcgaacagggccggccactcggccggcaccgcgccgccccgggacagcccggtgtcgagtttcaggtgcacccgggccggccgcccggcccggcgcgcggcggtgaccaactcgtcgagcagttccggggtggccgcgctcaggtcgacgccggccgtgatcccctcgtgcagcggctgcccgggggcgaacagccaggccagcacccgggcctcgatcccgccccggcgcagctccagagcctcgtcgagggtggccacgccgagccaggtggcgccgccggcgaccgcggcccgggcggccggaaccatgccgtgcccgtagccgtccgccttgaccgcgaccagcacctcggcggaggtgccggcgcgcagcatcgcgacgttgtcccggatggcgtccagattcacgcggacttcggcctgccacatgtcatccaccctactgaggggtacgacagtttccgttcaccccagtaggtgggccagcaccggccggatcgccgccgccacatccggcgaggtgaccggcccgtccgccgccgcatgccggccggccagcccgtgcacgtacgccgccgccaccgccgcccgcaccggcggcagcccggccgccagcagcgacccgagcagcccggccagcacgtccccgctgcccgcggtggccagtgccgggctgccggtcggattggcccagatctctccgcccggcgtcgccacgatcgtccggtcgcccttgagcagcaccaccgcgttcgtccaggcggccagccgggcggccgcggccatccggtcggcgcccggcgcctccccggccagccgcttgaactcgccgtcgtgcggggtcagcaccagcggcgcgtcccggcgcaggtgctcggcgtgctccccgccgaccagcagggtgatcgcgtccgcgtccagcagcaccggcaacgaggtggccagcacgctgcgcagctcggtgcgggcctcgtcgccggtgcccagcccggaaccgcagacccaggcctgcacccggccggcgtcggccaccttcggcgccgccaccaccgacgggtgggcgtggaccacctcccggtgggcgctgccggcgtaccgcaccatgccggtcgggccggccagcgcgccggccgtggagagcagcgcggcacccggatatccggccgaaccggtggccaggccgaccacgccgcgggtgtacttgtccgaagcagcaccgggacgcggccaccaggcggcgatgtcggccgcctcggccacccgcaccgccgggtcggcgaccagcgccgggcccagaccgatgtcgaccagctcgacgtgcccgcagcggggcgccgcggggcccaccaggtgggccggcttcagacacccgaaggtgaccgtgacatcggcgtccaccgcgtcgccgggcacgtcgccggtgtccacccgcaccccgctcggcacgtcgacagccacgatcaaaggccgatcaccggtacgtccccgcagctcgccgagcgccccgacgagcgccgcggcgggcggtcgcagcccaccgctggccccgatcccgacgatcccgtccagcaccagatcgacccgggtgggcaggtcggcggtggtgaagccgcccgcctgccgcagcgcggcgagcccggccagatgcacccggtccgggctgagcagcagcgcccgcacctgcgccccgcgccgcgccagcagggccccggcgtacagcgtgtcaccgccgttgtcgccgctgccgaccagcagcaacacccgggcgccgtacaccccgccggagtcctcgagcagcagcgcacagcggcgggccagaccggccgcggcccgctgcatcagcgcaccctccggcagcgtcgccatcagcgtcttctccgccgcgcgcacatcggcgacccgccatgcctgccgcatctctccccctaccgctaggccggccttctccactgcccggctgtcactgcccggctgtcactacccggtctcgctgctccgctctcactgctcggcgaccaccatcgcggaggcgatcccgccgtcgtgcgacagcgacaggtgccatcggttgatgccgcgctcggaggcggcggcggcgaccgtacccgagacggtcaaccacggccgcccgtccgggtcggtgacgatctcgcagtcgtgccagcgcagccccaccggcgcgcccagcgccttggccaccgcctccttggccgcgaaccgggcggccagcgactccggcgagcgcggattgcccgagccggtcagccgctcagcctcggtgaacaggcggtccccgagcagcggggtgcggtccagagcgcgggcgaagcggtcgaccaggacgacgtcgatgccgacagacacgatcacaacggacaccctaacggtcgccggaccgcctgtggacaagccgcgaaccgttgtccacaggccgtcccggcgggccggaaaacggcctaccttcggcgcatccgttccgccggcccgccccaggaggttgccccatgaatccggatctcgacgtggataccgagacactgcaccggatcgccgacgcgacggagggaacggcgtcccgggtgcgcgaggccgcctcgtcggccccgcacccggtcgccggcccccagtgggccaccaccggcgccgccaccatcacctcggacacggctgcccgaaccctgcgccaactcggcgccgacctctccgacaccgcctccaggatcaaaaccaccatcacggcgtacgcggcggccgacacccgagccgccacccgcctccggtccacccgatgagcctgcacccgatgagcgtcaccctgccgagcatcagcccgatgatcgtcgccgcaatggacgtcgacgcgatgggcaacgcccccatgaacctcaacgcgaggagcaacgcccgatgagcgttcacccggtgaccgtcgggccgacgctcaccgtcacctatgaccgtctgcgcgtgaccgacccggctcgctgggccgcagccgcgctgacctggcgccgctgggccgccctggcaggcgtgctgtgcgccgagttcgggccactgatcgagggcttgcgcacagcctggtccggcgcagccgccgaggccgcggtcctccggctggccacgctccgccgccgtctggtggtgttccgcctgctctgctggcgagccgaccagatcctcagcgagttcgccgccgctctcacccgagcccgcgcacttctggaccgggcccgggccgccgcagccgccgcggccagctcgggcggcctcggccagggcggtaccggcccgggcgccggcggcactagctagctagtcgggcagcgcaggcgcaggcagcgcaacagcgggctcgggccgtgcaggcgcaggcagcgcaaccgcgggctcgggccgtgcaggcgcgggcggaggtcggggcggagcaggaggcgtggatctggtgcccggcgtgcccgggccgggcgccgccgagctcggcaacgctctgcggctcgccgcgagcgccgacgcgagcgcggcagcgcgtctggccgagctgacggcgatcccggtggcgccggcttccgacgaccggccgagttgcacggccaccccggcgcaggtccggttgtggtgggccgccctgtccccgggtgagcggatgtggctgctcggcaccgagccgactgccttcggcgggctcaacgggatccccgccgccgaccgtgacctggccaaccggttgctgctcgccgatcgccgcgacgagctgttgcggcacggcgggaccgcgggcaccgtgcagggtctggaccgcctggcggaccggctggccgacgaccggggcccccgggcgtacctgatgggcctcgacgtctccggcgacggccgggcggtggtcgccttcggcgacccggatcgggccgccaatgtgctgacccacgttccgggcatgacctcggacctggcctcgctgaacggtgagctgacccgcgccgagcgggtcgccggccgggccaccgacctcggcccggccgaggcgaccagcgccgtcctgtggctcgactacgacgccccggatttcctgcccgaggcctcgtcggcccgccaggcccgggacggcgccggtgcgttgcggttgttccaggacggcctgcgggccacccacgagggcgcggccgcccggcagacggtgctcggccacagttacggttcgctggtcgtcggcgaggcggcgaccggcggcctggacgcggaccgggtggtgttcgtcggctcacccggcgtcggcgtcgaatcggcggcccagttgcacctgccggccgaccgggtgttcgcctcgacgtcgatcagcgacccgatccaatatctggcggtctccccggccggcgcggcccgggagttggtgccgggcctggggctggcgcccaccgagcacctctggttcggccacgacccgagcgacccggccttcggcgcccaggtgttccacacccaggccgacggcggccacctcggctactgggatcccggcaagccggccctcgacgccctcgccaccatcaccctgggcggacacccgaaatgaccggcagagcacacgaccccgaccagcagcccgaccaagcacacgaccccgaccagcagcccgggcgagtgcacgacccgggccgcaggtggagcgggtggggttggggggttggttattcgacggtgacggacttggccaggttgcggggctggtcgacgtcgtggccgcgggcggcggcgatttcgcaggccaggatctgcagcggcaccgtggtcatcaacggggccagcagggtgggggtgtgcgggacctcgatgaggtggtcggcgtaggccttgacgctctcgtcgccctcctcggcgatgacgatggtgcgggcgccgcgggcgcggacctcctggatgttggagacgaccttgtcgcgcatgacgccgcggccggccggggacgggaccacgcagacgaccggggtgccctggtcgatcagcgcgatcgggccgtgcttgagttcgccggccgcgaagccctcggcgtgcatgtaggcgagctccttcagcttcagggcgccttccagggcgaccgggaagccgacgtgccggccgatgaacaggatcgtcgaggcgctcttcaggtcgcgtgccagcgcgcgcacgtcctccatcttgtcgagcagctcacgcaggttgtccggggtgcggcgaagccgggagacgaccgcggcgacctcgtcggcgtacatcacgccgcggatctgggccaggtgcaggccgatcaggtagcaggcgaccagctgggtgaggaacgccttggtcgaggcgaccgcgatctccggcccgccgtgggtgtagagcaccgcgtccgactcgcgcgggatggtcgacccgttggtgttgcagatggccagcacccgggccttctgctccttggcgtgccgcagcgccatcagggtgtccatgctttcgccggactggctgatcgcgatcaccagggtggaccggtccaggatcgggtcgcggtaccggaactcgctggccagctccacctcgcaggggatccggacccagtgctcgatggcgtacttggcgaccatgccggcgtggtacgaggtgccgcaggcgacgatgaacaccttgtccacgtcccgcaggtcctggtcggtgagccgcacctcgtccaggatgatctcgccgcgctcgctgagccggccgagcagggtgtccgcgatggcctgcggctgctcggcgatctccttgagcatgaagtagtcgtaaccgcccttctcggcggccgacgcgtcccagtcgacgtggaattcctgcccggtcgccggggcgccgtcgaagtcggtgatctcgatcccggccggagtgatcaggacgacctggtcctggcccagctcgaccgcttcccgggtgtgctcgatgaacgccgagacgtcactggccaggaagtattcgccggcgccgcggccgacgaccagcggcgagttgcgccgggcggcgatcaccgcgtcggggacctcgacgtcgacggcgagcagggtgaaggcgccctccaggcggcgcaccacgcggcgcatgccctcggcgagcagcgccgggccgtcctggccaccggccgcgcgcagcgcccgcatctcggcggcgagcaggtgggcggcgcattcggtgtcggtgtcgctgcggaactcgaccccgtccgcttcgagttcggcgcgcagccgggagaagttctcgatgatgccgttgtggatgacggcgacccggccgtcggcggacaggtgcgggtgggcgttacggtcggtcggcccgccgtgggtggcccaccgggtgtgcccgatgccggtgtgcccggcggcgattccaccggcggcccgctccgccagggccttctccaggttggccagcttgccggcccgcttctcggtgtgcacctcgccggcgtcgatgacggcgatacccgcggagtcatatccgcggtactccagacgccggaggccatcgaggacgatgctcaaggccgggcgattgcctacgtaacccacgatcccacacatgccgggcagcgtagccgactttcgcgcaaacgtcatgcgcaagaagcactcttacgcgcatcgtacgtgatcggaaacatagatcggcgggcggccgccggtgcgggcgattgagccgtcgggcgccgctggcgtaccgtcagaacagccccggccaggcgggaacgcccccgcccggggcgtggcggaaggacgagatgagcgatcagcgcgatccggcgcgggactatccgcctaccgcacagtttgcgccggtcggatacccgccaccggattatcggcaacatcggcgcagcaacgccccgctgatcgcgctgatcctggcgatcaccctgctgctctgcggcggcgtgatcaccactgtggtgctggtcgcccggcgcacctcggacaaggccaaggagacggtgcagaagattccgaccgccctgcccaccccgagcaggctgcccaagctccccgccggtggtgacgacgaccacaccaagctcacggtgcgatacgaggtgagcggcgacggccccgccacgatcatctactcggagaaactgggactgccgaaaacggtcaacgaggcgaagctgccgtggaagatcgcggtccgcatggacgggttgtcgttcgtctcggtgtccgcgctgcggctgtccctgcaggacggcagcatcacctgcaaggccatcatcgacggcaagacggtcgacgagcacaccgcgaccggtgtcggcgccaccgcgacctgcaacaagctcacgttcaattaggggagcacggttgagcacggacccgctggtcgaacggatgcgtccgttcgggaccacgatcttcgccgagatgtccgcgctcgcggcgcgcaccggtgcggtcaatctcggacagggcttcccggacaccgacggcccgccggagatgctggcggccgccgcgcaggccctggcgagcggcgccaaccagtatccgccgctacccggcatcccggccctgcggcacgcgatcaccgggcacgagcggcggttctggggcctgacccgggacccggacaccgaggtcgcggtcaccgccggggccaccgaggcgatcgccgccgcggtgctggccctctgcgagccgggcgacgaggtggtctgcttcgagccctactacgactcgtacgcggcctcgatcaccctggccggggcggtccggcgcccggtcacgctgcgccccggcccggacgggcgctacgagttcgacgaggcgcagctgcgcgcggcgttcggcccgcgcacccggctggcgctgctcaactcgccgcacaacccgaccggtaaggtcttcaccccggccgagctggccctggtcgccgagctgtgccaggcacacgacgccgtcgcggtcaccgacgaggtctacgagcacctggtcttcgacggggtgcacgtgccactggccaccctgcccgggatgggcgagcgcaccctgcgcgtctcgtcggccggcaagaccttctcctgcaccgggtggaaggtcggctgggtcaccggcccggcccggctggtctccgcggtgctgcgggtcaagcagttcctgaccttcgtgaacgcctcgcccctacagccggcggtggcggtcgcgctggggctgcccgacgcgtacttccaggatttcaccgccgggctgcgcgccaaccgggaccggctgacggccgggctgaccgcggccgggttcgaggtgttgccgtcccaggggacgtatttcgtgaccgccgacatccggccgctgggcgggaccgacggcgtcgaattctgccgtgggctgcctgcccgctccggtgtggtggccgtgcccacccaggtcttctacgaccaccgggaggccggccgccacctgatccggttcgccttctgcaaacgccccgaggtgatcgaggaggcagtggcccgcctcaagtgaggcgggccgcacctgtcacgcgacggggctggcggcccgcacctcgtccgcgatgcgggcggcgaccgcaccggcctgctcctcggtcgcggcttcgaccatgacccggaccagcggctcggtgccggaggggcgcagcagcacccggccggtctcgcccagttcggcctcggccagcgccacggcggcctgcacggtcggcgcggctgcgccggcttcccggtcgcccaccttcacgttgatcagcttctgcggcagcttgtgcaccaccgcggccaggtcggccagcgacttgccgctcgatgccagctgcgccatcaggtgcagcccggtcagcacgccgtcgccggtggtggcgaacgccggcatcacgatgtgcccgctctgctcgccgcccagggccagaccgccgccctgcagttcctccagcacgtaccggtcgccgaccttggtctccagcagcttgatcccggactgcttcatcgcgatccgcagacccaggttgctcatcacggtcgcgaccagggtgtcctcggtcagcgtgcccgcgtcgcgcatggccaccgccaggatcgccatgatctggtcgccgtcgaccacgtcaccggccgcggtgacggccaggcagcggtccgcgtcaccgtcatgggccagacccaggtcggcaccctcggccagcaccgcgtcgcgcaccttgtcgaggtgcgtggagccgcactcctcgttgatgttcaacccgtccggctcggcgtggatcgcgatcacctcggcgccggcctcccggtaggccaccggaccgacatcgctggccgcgccgttcgcgcagtccaccacgaccttgatgccttcgaggcggtgcgggatcgactcgaccaggtgcttgatgtagtgctcggcgccgtccagcaggtcgtgcacccggccgatgccggcgccggtgggccgcccgaccaggccgtgcccgtccgcgaccgccttctcgatccgctcctccagctcgtccggcagcttctggccgccggcggcgaagagcttgatcccgttgtccgccatcgggttgtgtgacgcggagagcatcacgccaaggtcggcgccggtctgccccaccaggtacgcgaccgcgggcgtcggcagcacgccgacccggaccacattggcacccgcgctggtcaggcccgcgacgaccgccgcttccagcatctcgccgctggcccgcgggtcacggcccacgatcgcgagcggctggtggctgctgtcggcctcgaccaggacccgggcggccgcgacggcgaccgagagggccagttccggggtgagcagatcgccgttcgcgagaccgcgaacgccgtcggtgccgaagagtcgccccatggcggcttcctttcgccggtgacacttaccccgcaagcgtgcaacaacgtcgcgtcagggcaggagtaccggaacggctagttggggggaggggggtcgtgcagaggccgcaaaaaccacggcggccgggtggtcctcccgtttatcggaaggaacacccggccgccgtaggaaaaatcagcgcttcgagtactgcggggccttgcgggccttcttgagaccgtacttcttgctctccttgacccgagcgtcacgggtcaggaagccggccttcttcagggcgggacggtcgtcggcctcgtccgcgatcagggcgcgggcgatgccgaggcgcagcgcaccggcctggccggtgatgccgccgccacgcaggttcgcgatcacgtcgaactgctcggcgcgctcgacggtgacgagcggctcgcggatcagctgctggtggaccttgctcgggaagtagttctcgagctcacggccgttgcaggtgatcttgccggtgccggggacgaggcgcacccggacgatggcctccttgcggcggcccacggtctggaccggacggtcaccgggacgcggggcgcgaaccggagccggcgcgggcgtctcgacgacgacgaccgtctcagcgggctcctcgacggtctcgacggtctcgacgacctcgggctcgatgatgtcggtcatgctgctgccttctcccgcgctcactgcgcgatctgggtgatttcgaacggcttcggctgctgcgcggcgtgcgggtgctcggcgcccgggtagaccttcagcttcttgatgatctggcgcgccagcttgttgtgcgggagcatgcccttgaccgccagctcgatcgccttctcggggcgcttggacagcagctcctcgtaaccgacctgcttcagaccacccgggtaaccggagtgccggtaggcgaccttggtctgccgcttgttgccggtcagcgcgaccttgccggcgttgatgatcaccacgaagtcgcccgtgtcgacgtgcggggcgaacgtgggcttgtgcttgccacgcaggagagtcgcggtgtgggtagccaggcggcccagaacgacgtcagaagcgtcgataatgtgccactgacgctcgatctcacccggcttcgggctgtacgtacgcacagaattaccttgtctcgtcgtcggtctgggggcgcgcgctggtcgcgtcgaactcgacgtcgacacgacgatcaagcacaccccagagggagcgctcgccagctatcgcacaacagcaggcaacaatacccggccgcgcggcgcgtggtcaaaacaggctgcccctgggtgaatggcccgaggcgggacctcaaacggtatccagcatactcggtgtctgaggtcgtcctgtctcgggttcaccaactggctcgtggacggctcttagcaggctcgaaacaaatgggacgccacgccgaaattccccaccggcaggcttcccggcatggccatcggtgcggaaccccggacggcgcggcccggctctggccgaggcgacgcgtcagggcgcaccatggagagaccaccgtcagggttgaggacggacctggcggtgttcgccacaccggttcgccggagtggcgaggagaagtcgcggcgtgccccggacggaggcatggcgaggaccgtaagcgtgacatgggagcgggtctacgctgaggacgacgggactcgagcgtgcccttcggtggaccgcccggccacgccgcgacttctcactttcccatccccggccgctgcggcccttcccccgctgttcggcgccggatgacggagcggatcccggcggcacgacggtcggcgctggacgagcccgcggccgtcctggccggatacaccgtcggcgtcacctccgaccggcgccgggatgagctggccgccctgctggagggccgcggcgcccgggtcgtgctcgcccccgcgctgcggatcgtgccgatcgccgacgacgccgaactgcgcgccgccacccgtgcctgcctggactcacccccggacatcgtgctggtcagcaccgggatcgggatgcgcggctggctggaggccgcggagagctgggggctggccgagccactgcgcgcggtgctcgaccgctcctatctggtcgcccgcggccccaaggcgcgcgccgcggtccgtaccgccggcctgcgggaatgctggaccccggagggcgagagctccgcggaggtggtcgagcacctgaccacccgcggcctcggcgggctgaccgtcgccctgcagttgcacggggagagccagcccgaatacaccgaggtactgcgcgcggccggcgcccgggtgatcgagttgccggtctaccgctgggcgccaccgaccgacaccgcgccgctgcaccgcctcgtcgacctgatcgccggccggctggtcgacgccgtgacgttcacctcggcggccgccgtgcacgcactgctgcgcgccgccggtccggccgtcgatccgctgctggacgcactccgctcggacgtgctggccgcctgcgtcgggccggtcaccgccgagccgctgcgccggctggagatcccggtcacgacgccggcccgggcccggctcagcgcgctggttcgcaccctgaccgacgaactcccccagcgcgcggtctccctgcaggtcaacggccacgcgatcacgctgcgcgggcacgccgcggtgatcgacggccggctgcgccagctggccccggccccgatggcggtcctgcgcgccctggccacctcaccgggccgggtcctgtcccgcgccgctctcctgcaaaccctcccccgccacgccgacgaacacgcggtcgagatggccgtcgcccgcctccgggccgccatccccggcatcgtccagacggtcgtcaagcgcggctaccgcatcgccggctagctgtgatgtccggccaggttgttcaacctggccggacatcacagctagccccgccgagaattcgtcagtgacggaacaggcctgacggcgcgggcggtccggggcgggggccgcgtggcgcccgtgcccacccgcggatgtcgcccttgcgggccgggcgttctggacgcgtcagcggccagcccggcccgcaagggtcccggcgggagctacggtcagttatcggccgcagcgcacgacatctgcatcacagtcttgatcttgatcgtcgagcagcgactcacacggtcacgccctgctcgtgttcggcgaccagcgtggtcatggcgtgctcgacgacgccgatcagaaccgccttgaccgactcgcggtgccgggcgtcgcacatgatcagcgggacccgggccgggatcgccagcgcctcccggacctcctccggctcgtagcgcggcgcgccgtcgaagcagttgaccgccaccaggtagggcaggtgccggttctcgaagtagtccagcggggcgaaggcgtcggtcagccgccgcgtgtcgaccagcaccgcggcgccgaccgcgcccctgatcaactcgtcccacatgaaccagaaccgggtctgcccgggcgtcccgaagaggtagaggatcagatcgtcggccatggtgatccggccgaagtccatcgccaccgtggtggtgcccttctccggcaccttggaggcgtcgtcgatgccggccccggccgcggtcatcacggcctccgtggtcagcggctcgatctcggagaccgcgccgaccagggtcgtcttcccgacgccgaaaccaccagcgatgacgatcttcgcggaggtgatctccgaaggggacgcccccgcccactcagagcttgcgaagtccactcaaaacccttcccagcagatccatccgctccgtgaagccacgcttgggagcggcactgtgcagcgcgagcaaaccgtcggcgaccatgtcggcgacgaggacccgggccaccccgagaggcaaccgggtcaacgccgcgagctcggcgagcgatagtgctttcggctcacacagcgcggcgatgcggtacttgtcgtgcccggcgaaacgtgactcctgcacggccgccgggctggcgaccaggaccgcttcgatcgggatgtcccggatcggctcggtccggccgcgggtcaccgcgtacggccgcaccaggttgccccggggatcgtgcggctcactcatgtcgcggtcacctcatctccgccggggccgggggccccggcgctcaggctctatctggcgtggccgacggcctcgcgggccaccggcgacagggcggcgccgacgcgctccaccagcagggccatctcgtaaccgacctggccgacgtcgcagctgcgcgcggccagcaccgccatcgaggaaccgtcgctgatggacatcaggaaaagataaccgctgtccatctcgatgatcgtctgctgcaccttcccggcgctgaacatccgggacgcaccgtcggtgagactgaccaccccggaggtgatcgcggccagttgatccgcccggtccggcggcagatcccgggagcatgccagcaacaggccgtccgcggagaccgccaccacgtgcgcgatcccggcgatgctgtcggcgaagttgttgagcagccagcccatgtcctgcatggtgggaggcctggtcactgtcgattctccttaggagccggtggtgcctcggcggtgccatcggtccgccctcgctgcaccccacgggtgtacgcggacagcagtccacggacgtcgtcggggctgcgacgatgctgtgcgcggggcgggtcggtcaccccgccgggaacgagctgcgcctgcgggatgcgcttcggcagcccggatcgggtggtaccggcgtcccgcggctagctagctaggccaccggtcctcgagcgccgggcggggacgcggcaccgccccaccgccggagaccggcgccgcgctcgccgcgggcacggagacggacgccgcactcgccgcgggcacggagacggacgccgcactcgccgcgggcacggagaccggcgccgcactcaccggcgcggtggcgggcatcgcggagaccggtgccggcgcgtagcccgcggtcggcatcccgcgcggaccggccgccgcctccccctcgaaccagctgtgctgcatcctgacctggatcggcgccgacaccggatgcacggacaccggatgtgcggacaccggatgcgccgagacgggcgcggcggccggggtgaacagcggcgtcggggcgggttccgcgcccacgtccggcttcggcactcgggtgggcagcggcggccggtccggtgtcggccgcaggtccaggtcgggctgcgggccgggctcgatcgccgcccaccgcggagcggccggcgcggtgggcgccgggacggtacgtaccggcgggcggacctccggcgtagcacgctccgctccggcgatcgcctgcggcggcgggccgggacgtgtccagctggccgcgcgtcccggggtgctctgcattccgggcaggacggtgacctcggccggcaggctgatctcggcgatcgtgccgccctcgcggtgcggcagcaggcggaccgtgatgccgtgccgggcggcgagccgggcgatcaccgcgaaacccatcaggcggaacgcggccacgtcgacctcggccggttcggccagccgccggttgatcacctcgagttgttccggggtgatgcccaggccccggtcctcgacctggaccacgagctgctcaccggagcgccgtccgtgggccatcaccaccgtggtcggcggcgagaagcgggtggcgttgtcgagcagctcggcgatcagccggaccacgtcgttgaccgcggccgcggcgaccgccacgtcggtgtcgatcgcgccgaactcgatccggtggtactgctccacttcggactgtgcggcgcgcagcacgtcgaccagcagggcgtcctcgcggcgcggggcgcccacgtcggcgccggccaggaccagcaggttctcgtcgttgcggcgcatccgggtggcgaggtggtcgaggtcgaagagcttggcgagccgcttcgggtcctcctcggtgcgttcgatctggtcgagttcgccgatcatccggtcgaccagcgcctgactgcgccgggccaggctgaggaacatcgcggagacgctggtgcgcagggcggcctgttccgcggcgacccggatcgcctcccggtgcaccatgttgaacgcctcggcgacctggccgaactcgtcgcgatcggtgagccggaacgggtcgcgggtctcggcgacgatccggtcgacgccaccctcgccgaggctgtccgcgtcctgcagccgggtgaccgcgtcgggcaggtcgcggtgcgcgacggcgagcgcgccctcgcgcagcatccgcagcgacaggtgcagccggcgggcgaggaaggcggcgatcgcgatcgcggcggtcagcaccagcagcacgacgatgaactcgacggtggcccgccgcgcggcggcgtcccggtcgtaccgggcgtcctcggcgacctgtccgtcgagtctgccgccggtgtcctgaagcagatcgaggacttggccgtacgtcgtggtcagctcgtcggcgtccaccgacccgccgccggcaagccgggtgaccagtccgtccgcctgggccaccacggggttcgacagggtgctctcgaccaggccgatctggtcgcggtcggcaatctgccggaagtcgtcgagcgccgcctgccgggcgacctgagcgccgatcagctcctgttgctgggccgcgccgagctgacgggtggcctgcacgacgtacccggtggcctcctggtcggccaccgcctcctggatgcggccgaacgcggcgagcccgcggagaccgtcggcgaccgtgcccggctcggcgatctggacgaccacgtcgtcgaagtcgaagatctggtcgagcgcctggtcgtagcgctgggccatggtgacgatcggcaggtccttgcgggcctcgaccgcgccccggatgtcggtgagcgtgccgagctgctcctggatcagccgaagccggtcggcaacccgggccgggacgtcaccgagggcggtgcggtgcgcacggaaggtccggatctgggtgtcgaccgcctcggtcgccgtccggaaacggtccggcgccgcgccggtgtcggcgaggaacgcggcggcggccatccgctcctggtgcagcagccggctcaggccggagaggtcggtgccgatccgggtgaggtcggcgacccggccggcgtcggacgcggtgccgcgtacgtcgatcagccgcaccgaggccagcgccagagcggccaccagcggaatgaccatcaggccggcgagtttggtgcggatcccggcgtcgcgcgaccaggagagcggaccacgtcgcacaggcaggcccgaggatcccgtgctcacgacatctccttcgcggtagtcccgcttcgctgggcacccttttgccgggcacccgggaatgtcgcggcggcgagcggggcccgcggtccgtccccgatcggcacgcgtagcaagggtcgtgccgttatcggcacggcggcgatttcatcagaccctctaccgttttgggaagcctggatcctcccgcaaacatcccggctgtccgagtgataaccgcgcgcgacaacgaacggcccccgcaacaaacgctttgacgtgcgcgaatggttcatgcgtgaccgccggcgcggttccggccccggaacagcttcaagattccaaccactatgtgagagtcccgtcccgcgcctgagtgctgagcaggagtctcacgttcgcaagctttggcacgacgcaacggacatgctgtccgcgtccgcccagtgtccactctggaggcagcggccggcaacccatccgtacgtcgccccggggtgactgagcgtcacggagcttaatcgacgtacttcgatagggaagatccagactttaggccgccttaagaagggccgctcccactggcgtaccggccgccggattacgtaacgtgcgcggcatggcatttcggagctgggtgaagctgctcgccaccaccgccacggcagccgcggtggtcggcgccggccaactcggcatcgcctacggcctcggcatcgtgcggctcgaccgcgtcctcgacgtcactgcgcgtgatcaatggaccgcccatctggcctgggtcgcctggatcacgatgaccgccgccgcgctcggcgcgatcgtcggcaccggcatgcgggcccgctggctgccccacccggccggcgccggcggcgcgctcgccaccggactcgccggcggcctcggctccctggccgtcctgccgctgaccatgcagccggcccgagccgcgcaggtcgccggggtgcagccggtcttcgtcatcggcgtggtcgccgggctcggcgccgcggccggcatcttcgccggctgggcggccgccgccaaaccggccgcccgctggaacgtggccaccctgagcgtgctgatctggctgatcgcgctggtcaccatcgggccgtcgctgcgagccgggcacaccccgcccgcggtccggctcggcgtgctcggcggcagcctcatcccggccgccgtcagcgcgcacaccgcactcctcaccatgccgaccctcgcgctgctcgccggcctggtgatcggctccaccgcccgcgggcgcaggatgtcgacgctggccgcgggcctcgccgggttggccggcccggccctgctcacggtcgcctacctgatcgccgggccggaactgaaagcggccggattcgccgacgacccgtactgggcggcgatgaccgcgtgcggggccggggtgctcgggtcggtcctggccgccatcgtgcggggaaaccccgcccccacggaaagcgcggactcccccgcggagaccgcgtcgctgccgaagcgggacgtccccgcccggtccgcgatcgcccaggccgcggcggccgccgccgcgcggcgcccggaggaacaggtgcgtcctgccgacaccggggtgatcccggccgggcaacccgggacgccggacaacccgttctccggcggcaccggcagcccgttccgatccgggacgccgttcccgccgcagcccgtgccgacccaggcgccaccgcaggctccggcaccggagaaggcgccccgcttctccgggcagcagccgaccccgatcgccaccgggcgcggcggctggcgcggacgccgctcgaccccggcccccgcatccaccccggcgccggccgccgactccttcaacggtttcgccgcggcccagccgcccccttctcccgcgcagcgcggaccggtcgtcgagcccacctcgatcagcagtccgcgccggtccggccaggaaacggactatgtcgactgggtgagcggcctcggcggccagtaaatcattcgtaaactccgatgaaatggtgcttccgggaggtaccacggggcgttccgggcaggcacgatgatcgatgtccgggctcccttcccccgaagcatcggagttgacgaacgtgaccacttccctgccccgcctccgaaagctgctgctgagcctcgccctgatcctgggcctggccggcaccgcgctcgccgtcccgtccgccgcccaggccgccgtctactcctcgtgcacgatcagccggtgctcggccgcccgcaccgcgtacaccggctggcagactctcggctggccgctgagcagcggctggtacgtctggccgtacggcagctacaactacaccggcggcaccttccagaaccgtgagggctacctgccgtcggccacctacaacgagtacgacgtgtactcccgcgccaagggcgcctcgcgggacgcctaccgcatcgtggtcaaccgcagcaccaaggtcgcctacttcaccccggaccactacgtgacgttctacaaactttgattgctttgctgtacgtcacacctcatccccctcgtggcggccgtccccggacggccgccacgagccgttccagcgccgttccggaccacccgcccgaatccccggcccgatccgctaccggcgcgcaaccgatagcaccgaaccggctctcatgcaccccgaacaaatagatcggaccgagagaattcccagctatctcttaggcggaacccggccacgaccgaacaaccccatgccaggggataacgaagtccgctcggcgagaagggcaaacccggcgcgagccggggacgcaaagccacaggacccaagaggtcggctgggctaccaccgaacgaacaggggaacagatatgcgcagcatgcttcagctcgtgggcggcgtcgcggcggccggcgtggttgccgccggagccaccgctttcaccgcgcccggcctgaccaacagcgtggcaacctccacgaaggttatctcggccggttcgctgtccttctcgaccgtcgagggcgccgagctgaccagcgtcgtcaccctttccagccgcaccaacaaggcggaaatcaccggagtccggctctacctggcaggcctgaacagcacggcgctcaacacgaccaccaccgtcgtcaacgcgtccatcaccggcaccagcgcccccgccggctccgtggtcggcacggtgcgcaccttgacctgcgcctacaactcgacgccggcggcctgggactgcaacgtcaccaccgcgggcaccgactacctgaccgcgctcaccgccgtcaccgtcgacgtccaggccggcgtctagtccgaaagatccgtcggcgccccaggcccggcattagcgtcagacccgcggcaccgacgcccggaggacgccatttcccgagtccgacgcaaagcgatggccgccatcctgttgatggcggccatcgccgcgtgggccatcggaacccaccgcatctcctacgtcgtcacgcacggcatcagcatgaacccggtctactacgccggggacctggtggtcgtcgtcaaaagcgattcctacgaagtcgggcagatcgccgcataccatggtgtcggcggcgtggaaaccctccaccgcatcatcggcggcgatcccgacaccggttacgtcttcaaaggagacaacaaccagtcgatcgacatcccgcaccccacagcggatcaactcatcggacgcgcggtcctgcacgtctcgcagggcggcgtctgggtccgccggctgctgagcccggccaccctgggaatggtcggctttttgatcatcggcgccggcagcccggccggcgcccggacccgcagagacctgcgtcgccgtcgacgcgagaggaaagcgaagggcatggctggccaagggggctcgtggacagcggccgcggtcgtggtcaaggccgtcagccgccttcatcccctgcttcgcgtcctcgccgtcgggaccgcctgctgcgcgctgaccggcctggtcctcggcgtcctgagctggatgaagcctgccacgcaggcgagtccgagcagctcatcgagcggcgagtcggtgaccttctcatactcggcccaggtccagtcgtcggccgcctacgacgggacggtcgcctactcccccgacccgatctatcggaagctggcgcacttcgtcgacctgcggctgcagtatcacggcaagcccggccggatcggcgtcgacgcccggctgtccgcccaggcctggcactcgacggtgcagctggcccagtcccgccagttcaccgccgaccggtacaccggcactgtcctgctcgacctcgacggcatcgacgagcgggtggcggacgccgccgacgcgatcggcaccgacctcaccccggtcaccatcatggtgacggcgcacatcgaacaccccgacgggacgtcgttcgagccgcagctctccctctcgctcagctccctgcagctgagcctgagcggcgacgcgaacagcctgatcgtcagccagtccggcaggacgtcgggcggcgggatctatccccggcagatcgccgtgctcggccacgacctgatcacggcgggccgggcccggacgtacgcgttgcgcctgctcctgatcgcgatcgtggggatcatcggcatcggcctggccgcggtgcggcacgtgccgctcgccacccgggctcagatccagcggcggtacgggcatctgctggtgccggtcgaaccgctgaacggcaagcagggtgaagcggtcatcacggtggcctcggtgccggcgctggtgaagctggcggagaagtacgggcagatgatcctcacctggacccggccggacggggcggacgacttcgtggtccgcgacgacggggtgatgtaccggttccggatcacgccgcagcgtccggttaccgggaaaccgccgctgtccggggttccgcatccggcccgccggtcccagaggtccgccgccctcggcatcgcgtccctggtcacggccccacctcagcacaccaccgaagccaccgcggccaccgaaccggccaccccgtcgcccgagcccgcggcggccaccgcaccggacccgagcccggagcccgcgcccgcggtgcccgcggaacctgccgcggcctccgagcccaccccggaacccgtcgcggaagccccggcttccgccacggaatacccgcagcccgccccagagcccgtcgtagaagccccgacacccgccacggaatacccgcagcccgccccagagcccgtcgtagaacccgccccggaaaaccggcagcccggcccgcaacccgtcgcagaagccccggaacccgtcgcgaaggccccggcgtccgactctcccgagccgacgccttccgcaccggaatcggctgtacccgcaccggacgaagaagaactgaagaaggagccggaagactctgagccggcaaaggcggacgccgcagacgaggggccggaggcggctgccgagactcccgtccccgaacagcgcaccgaacccccggccgaagcggggttcgcaccacccgctgagccggagtcgacgtcagaggcggacaccaccgaatcttccgccgaagcggtggcggccgaagagaaggccgaggcatcgaccgagaaggagccgatgcccgccccggttctcgaacccggcccctcagccgaggaagaacccgccgcggaggcgaggccggaagttcccgcggaagcgaagcccgacgctcccgcgcaagtgaagccggagaccgctgcggaggcgaagccggaaaccgcggcgcaggcccccgcggaggcgaagccggagaccgctgccgaatccccggccccggctcaggcccagcgcccccgccgcacccgcaagccgcgccaaaagcccgaatcgaagccggatccggatcccaccatcgccgcgccggaaacaaatgccgcgccggaggcgaaggtcgcgcaggaaacgaccgccgcaaccgtgccggaggcggaggccacgcaggaaaggaccgccgcagccgcgccgcaggcggaggccgtcaccgccgggaaaaccccgcagaagcgcgccccccgccgcaaaccgcgccccagaaaagccaccccatcacccaccgagacgaaggccaccaccccgatgagcacagagttcgcccccgccgaggtcaccgcgaaggccgccgtcgatgaacgacaggcggccgaggacctcgccgaccgcaacaaggatctcgacgaggccatcacccgcaaggctgtccgtgaccaggcggccgccgaccgggcccgccagcagcggctggcgaagtccgccccgcgggacccggcctacgattttctgccccgcaatcagcgccctgaccagcccgaagactagttgtccacaggctgtccacaacccttacggcacgaccggcaggtagacccgcgctccgccgtcgacgaattcctcggacttggctttcatgccggcggcccgcagctcgtggctgatcttcatggagcagaatttgggcccgcacatcgagcagaagtgcgcggtcttggcgggcgcggccggcagtgtctcgtcgtggtacgaccgggcggtttccgggtcgagggcgagttcgaactggtcttcccagcggaagtcgaaccgggcgtgggacagcgcgtcgtcccacgcctgcgcccccgggtggcctttggcgaggtccgccgagtgggccgcgatcttgtaggcgatcatgccggctttgacgtcgtccttgttcggcagaccgaggtgttccttcggggtgacatagcagagcatcgcggtgccgaacatgccgatcatcgcggcgccgatcgccgaggtgatgtggtcgtaggcgggcgcgatgtcggtggccagcggcccgagggtgtagaacggggcgccgtcgcagagttcccgctgcaggtccacgttctccttgatcttgtgcatcggcacgtggccggggccttcgaccatcacctgcacgtcgtactcccaggcgatgtgggtcagttcgccgagcgtccgcagttcggcgaactgcgcctcgtcgttggcgtcggcgatcgatccggggcgcagcccgtcgccgagcgagaaggtgatgtcgtactcccggaagatctcgcagagttcccggaagtgggtgtagaggaagttctcccggtgttcggccaggcaccaggccgccatgatcgacccgccgcgggagacgatgccggtgacccgttcagcggccagcggcacataggcgagcagcaccccggcgtggatggtcatgtagtccacgccctgctcggcctgctcgatcacggtctcccggaacagctcccaggtgagtttcagcgggtctccgttgaccttctcgagagcctggtagatcggcacggtcccgatcggcaccggcgagttgcgcacgatcgcctcccgggtctcgtggatccgcggcccggtggacaggtccatcacggtgtccgcgccccaccgcgtcgcccaggtcagcttctccacctcctcggcgaccgacgaggtcacggccgaggtgccgatgttggcgttgaccttcacgaggaacttcgatccgatgatcatcggctcggactcggggtggttgcggttggccggtagcaccgcccgcccggccgcgatctcgtcgcgcacgagcgaggggtcgactccttcgcggaccgccacgaactccatctccggcgtgatgtcgccggcccgcgccgcggcgagctgggttcgcccgtcccaccagggtttccgcagtgcgggcaggccctgctcggggtcgctgcccgggcccgaggtgtcgtagagccggaccgacgggttgtcgccggtcagcaccacctcggtgaacgggacgcggatctccggacgggagccctccacgtagaccttgcgcctcatgtttcctcccagataggtataaaaccggcgaccgatggcagcactgatcgccggatgtcttgtcatccgtcagccggagaagtggttcagcggcccgggcccggcacccagccgccacgcggcgccaccgcgcagcgcccccgacacgtactccttggccgccgcgaccgccgccggcaccgggtcgcccatcgccaggcgcaccgcgatcgccgacgagaaggtgcacccggagccgtggttgttcggcgtcgaaaccggctcgccgtgcagttcggtgatccggccggcgtcccagaggacgtcgaccgcgagatcgcttccggtcaccaccacggcgcgcggcccggtcgcggcgatctcggccgccgcggcggccatctccggcaccgtctcggcccggcatccggccagggctgcggcctcttcccggttcggcgtcacgacccgggcgtacgccgtgagcacccggaccgtcgccgcctcccccagccggctcccggaggtcgacaccagcaccggatcgaccaccagattcggcagttcggcggcccgctcggcgatcactttcgccaccgccgagtcggcgatcatcccgaccttgaccgcggccacggtgaagtcggtcagtaccgcgtcgagttgtgccgccacgatcccggccggcaccgggtggatcgcggtcactccgagcgtgttctgcgccgtgatcgcggtgagcaccgacaccccgtacgcccccagggccgcgaacgtcttgaggtcggcctggatcccggctcccccaccggagtccgacccggcgatggtcagcaccacgggcggcgtcatcggacacccccgaggtcggcggccgcgggcgacccggcggcggccgcggcgaaggcgccggccaggacgcgggcgacccgttccgggttggcggcccgcatgatcgcgccgagtacggcgaccccatcggccccggcggtcgcgcaggacgccgcccgggccgccgagtcgaccccgccgagcgccagccacggcatccccgcggcgagccgcgcggcccgatccacgcccagatccggcccgtaccccggcttggtcgcggtcgggaagatcggcgacagcgtcacatagtccacctcggacaccggctcggtgccgtgccacgatctgccgaccagcggcacgccgcccggccgtgggtcggcggcggccaggtgcacggcggcaccgccgagcggatcgggcccggccacgatcagccgcccgggcgggaccacggcgcgcagttgcgcggccagggcggcacggtcgccgtacggcagatcgcgttcccggaggatcacccagcccgcgccgccgcgtaccgccgcggccaccgtctccaccagcggcccggcggcggaccgccggtcggtgagcacgacgagcccggtcggcgtcaccacaccgggatcccctcgtccggtgtggacgccacggcgtggaagcgacgggggatgcgaccggcctgccgggccagtcgtccggcggcgaccgcgtgccgcatcgcggtggccatcacggccggctcgtcggcccgggtgatcgcgctggcgatcagtaccgcgtcgcagcccagctccatcgccagcaccgcgtccgaggcggtgccgatgccggcgtcgaggaccaccggcacgtccacgctctgccggatcagctcgatgtggtgcgggttggcgatgcccagtccggagccgatcggcgagccggccggcatcaccgcggcgcagccggcgtcggcgagccggcgggccaggaccgggtcgtcggtggtgtagggcagcaccgtgaatccgtccgcgaccagcgtctcggccgcccggagcagctcgacgccgtccggcagcagggtccgctcgtcgccgatcacctccagtttgatcaggtcggtctcgaacgcctcccgggccatccgggcggtcttgaccgcgtccccggcggtgtagcagccggccgtgttgggcaggatccgcacccggagccggtcgagcatcggcagcagtcccggaccggccgcctcgatccggcgcagcgccacggtgaccaggtcggtctgcgaggcgacgatcgcctcttcgagcgcggccaggctgttcgcgccgccggtgccgacgatcagcccgttctccggcaggagatcgcccatgtcagccgccctgcgccgcggtgagcacctcgaccgcatccccgtcggccaggtccacccggtcccacgtggaccgggggacgacggtcccgttcaccgcgaccgcgactccgcggtgcgcgtcggtgatctcggcgaccagcgcggccaccgagcagccggccactctcgtctggtgccggccgttgacggtcaggcgcatccgaacctcccgggggtgaaatcgtcgatgatcgggtcggtggtgccggtgaggaccaggtcggcgatcagccgcgcggtgatcggggcgagcagcacgccgttgcggtggtgcccggccgcgaccagcacgccgggtcgcagcacgccgaggatcggggcgttgtccggggtgcccggccggtgcccgacggtgacctcggcgagtgcgtgctcggccagcccgggcaccaggtcgagggcggcgcgcagcaggtcgtggacgccgccggcggtcgcctgccggtcggtccgctcctcctgggtcgccccgaccacgacttcgccgtcggcgcgcggcaccaggtagacgtgccggccgtcggccgcaccgtcgatcacgtgccgcagcagccccggctcgccgcgcagccgcagcatctggcctttgaccggccggatcggcagcccggtgagcggtgcggtgccgcagccggccgcgacgaccgtgacgtcggcgtccacttcgcagagatcgcgcacgtcggcccggacgatccgcccgccgaggatgccgcgcagcgcggcgaccacccggcgtggatccacctgtttctcggtcggcgcgaagaccccggcacgcacccgcggggacagcgccggcgccagttcccgcacccgcgatccggtgagcggggtcagtttctggtgcttccactcgcgtgccatttcggcgacatcgtcggccgtcatggcgacgccgatcgttcccgcggtgtcatagccgacgtcaccgagcgacgccgcgaatgccggccacaatgcgttcgacgctgcgagcagccgctccagtccgggaaactcgaacaccgattcgccgcccggcgcgagcattccggcagccacgtgccaggcccccgcggagccgtccggctccgggtcgtagaccgtgacatcggcgccacgacgcagcagttcgaccgcggtggcgagcccgatcatcccgccgccgacgattcccaccctcattgcagggccgccagaaaggccgcggcagcgcccgcggggtcaccgtcgaaagccttcaccgcggctacgccgtacgtcgtgagcagccccacccgctccagagtgatcccgccgatcgccaccaccgggatgcccggcacggccgcggcgaccgcgttcaccccgtccggtccgagcggcggcggcagaccgtccttcgtggaggtgggaaaggccgggcccaccccgagataggtcgccccgtcggccaccgcggcgcgcgccgcctccggtgtccggcaggtggccccgatcaccgcctccggaccgagcacccggcgcgcggcggccaccggcaggtcgtcggcgcccaggtgcacgccgtccgcgccggtcgcgagagccaccccgatgcgatcgttgaccaggcacaacgcccccgcggtgcggcaccggggcacggcttcgcgggctacggcgtacgccgcgaagtcgttggtcttgaccctgatctgcaccgcgacgccgggctgcgccaccgcccggacgacatcgagatcgtcggtgatgacgtggagacgggggaacgaaacagcgcccatgacgcactcctccctgcgccggcatgacccggatcaggttcgacggtcgggggccgcatcagcccccctctcagcccggtgcccggactcccgtgggttcttgtaaccggaccataaccggtccgtgacgagaaaactagcggacgtcccagaccggttcagggacctcgacaacttcgttatcgctcctgaacagcacgaagcgatcgaaggaccgggtgaaccagcggtcgtgggtgacggctatcacggtgccgtcgaaggccttgaggccctcctccagcgcctccgcggaggccaggtccaggttgtcggtgggctcgtcgagcagcagcagggtggccccggacagctccagcagcagcaccaggaaccgcgcctgctggccgccggacagggtgccgaaccgctggtcgccctgagcgccgagctcatagcggctcagcgccttcatcgcgccggcgcggtctactcccgaccggtgctcgtcgccgcgccagaggatctcgaccagggtgcgctcggtcagctcgggccggtcatgggtctgcgagaagtggccgggccggacccgggcaccgagccgcgccaccccggagtgcgcgacgtgcgcgagcggtgcgccgtcgaccggcttgtgctccaggtcgggttcgctgccgccggccgcgagcaggcgcaggaagtgcgacttgccggtgccgttggcacccagcaccgcgacccggtcgccgtaccagatctccaggtcgaacgggaaggtcagatcctccagttccaggctctcgcagatgaccgagcgtttgccggtacggccgccgcgcaggttcatccggaccgactgctccttgggcggcagcgggggcggcccggcctcctcgaacttgcgcagccgggtctgcgcggcctggtagcgcgaggccaggccgtcgttgaaggccgccttgttcttgagcgtgaagaccagctcgcgaagtttctcgtgctcctcctcccagcggcggcgcagctcctccatccgctcgtgccggttcgaccgggcctcgtgccaggaggcgaagccgcccggatgggtccaggcgccgccaccctcgaccgcgaccacccggtcggcggtctgggccagcagctcccggtcgtgcgagacgtagaggatcgacttggccgactcgcggatccgctgctccagccagcgtttcgcgggcacgtcgaggaagttgtccggctcgtcgagcagcagcacctcgtcagggccgcgcagcagcaggtcgagggcgaaccgcttctgctcgccgccggacagggtgcgcacgatccgggaccgggcctcgtcccacgacctgccgaggatcgcgacggtcaccgtgtcgaacagcacctcggcgtcatagccgcccacctcaccccagtgggccagcgcgttcgcataggccagctgggtgcgctcggtctcgtcgagcgccgcggtcgccgtcgcaagccgctcaccggccgcccgcagcggcggcgcgaccagcgacagcgccagatcctccaacgtccggtcgtcgccgatcatgccgatgaactggcgcatcacgcccagcccaccgacccgcgccacggtgccggtctgcgccgggatgtcgccggccaccatccgcatcagggtggtcttgccggccccgttcggacccaccagcgccaccttggcaccctcgccgacccggaacgacacgtcggcgaacagctcgcgcccgtccggcaggacgaacccggcgccggccacatccacgtaccccatgcccggcatcctgcccggtccaggtctcagatggcagccggttttccggtcacccgcagcacccggaaccccttctggctggcgatccgctcgaccacccagccccggtcggtcagccaggtgtgcagcgagtcacccccgaggttccggttgatcaccagccagcccaccccgcccggcgcgagccggggcagccagcggtccatcagcgcgtgcagctccgccttgcccacgtgggtcggcgggttgctccagatctgcgtgaacgacaccccggccggcacgtcgtcgggcgccgacacccgcacccggccggccagtccgagggccgccgcgttctccacggtcagctcccgcgcccgggagttcacgtcgatcgcgtgcaccgtcacccgcggcgcctcgctggccagcacacaggtgatcggcccgtagccgcacccgatgtcgagcagcgcaccctcggtcgccggcccgggcagctccgccttgcgcagcaggaccgccgtccccggatccagccgccccgccgagaacaccccgttcgccacggccagccggtagtcgcgcccggccacactgaactcgatcgcactccggcgcagtggcgcgtccgggtcggtgctgaagtaatgctcggcgctcacccggtcagtctcccgtgtcacaacgccccggcggcgaccgggtgtcggacaccgtgtgcgttcatcgaccgacgtacgctcctaggttgtcacccatgcggtacgccaccccgagccgctccgcccaccgcgccgccccggcacccgatctgatgctcctgctccgcagcttcgcctggccccctccgcgggcagccggacccttccgggccgccgggtccggcaggcccgccgccggccagcaccggacaccagcccggacccggcggcacgcctggcgtgagccgcaccccgcccacctgatgctcgcccgcggcttggccgccctcatcgtgctcggcatcatcgccaccctcagcttcctgatcgtcagcgacgatcagcagccgggcaccgaccccgaccaggcgctcacctcgcgcgccgccgacccggaaccgctgaccgtcgccgaggccttcccgcccggcgccgccggttaccgggtggagaacacccgggcccagtccgactgcactctcgcggtcaccggcgccctgcggtccgcgctgaccgcgtacggctgctcccaggccgtccgcgccaccctcaccgtccccgacggcgactaccgggtgaccaccggcatcctgaacctggtcgacgccccgggcgcggccgcggtcgccgaccaggtccggcacctggtggagaccggcgacggcagcttcaccgcgctgaccggcaccccggtcgaacccggcaccccggtcggctggcgggcccgcggccactacctggtgtactgcgccatcaccggcccgggcggggtcgcggcgaccggccaggaccggcggctgtccgagataaccgcccaactgctcgacacgtacctcagcaaccaggtcctggcccgccgcgcttgaccggtgggcgaccgcggcgcggccggctcagggcagggtgcgcagccggcgggtggcgtcggcgcggaccgcgtagtcggcctcggtgggataacccaccgcgaccagggtcagcccgtgcgccggcgcgaccgtcacctcgctggagcgttcccgcagggtgagcagcttcgccggccagtccggcggacgacgtccctcaccgaccgcgagcatcgcgccgaccaggctgcggaccatcgcctggcagaacgcgtccgcctgcacggtggcgaccagcgtccggtccggctcgcgccgccagtcgaggcgggcgatggcgcggatcgtggtggcgtgctccttgcgtttacagaaggcggcgaagtcgtgctcgccgagcaggccggccgcggccgcgttgagcaggtccaggtcgagcggacggacccagcccagggtgtcgtgccggcgcagcggttcggggccccagccgtcgtcgcagacccggtactcgtagcggcggaaggtggccgagaagcgggcgtcgaaggtggccgggaccggcagcacccccttgacccgggcgtccggcggcagtagcccgttcagccggcgcagcagcgtgccggccaggtccgcgtaccgctcggcgggcaggtcgatgtggcacacctgaccggtggcgtggaccccggcgtcggtgcggccggccacggtgaggccgagcggcaggtcggcgccggcggctccgaggatgcggtgcagagcttcggtcaagaccccggcgacggtacgtcgttccggttgggccgcccagcccgagaagccggcgccgtcgtacgtgacgtcgagtcgtagccggatggtgtccgtcatgccgcagtgcgctcctcggcctcgccccgagcggcctcgcgtcgccgcggccacgggacggtgctcgggtcgtacgaaacaatcgtggttgtcaagggcgaagggcccggcaccctgagcggatgccgagcccttcgtgatgacgcgaagatcaggccttgatgtcgtcgccctcggcctggttgcccgggccctcggcgcccttgtcaccggaggcgttgaccggagcctcggcgtcctggtcgtcggcgacggtgtcgtcggcgaccgccggaaccgtctcctccggagccagcgcctcgaccttgtcctgctgcgcggcggccttgcgagcggcagccttggcggcgggagcggtggtggccgcgaccggggcctcctcgaccagctcgatgatcgccatcggagcggcgtcgcccttgcggggaccggtcttggtgatccgggtgtagccaccgggacgaccggtgtaccgcggagcgatctgctcgaacagggcgtacacgacgtccttgtccttcacgacggtcagcacccggcgacgggcgtgcaggtcgccgcgcttggccttcgtgatgagctgctcagccagcgggcgcagccgcttggccttcgtctcggtggtcttgatcttcccgtgccggaagagctcggtggccaggttggccatgatgagcttctcgtgtgccgggctgccgccgaggcgggcacccttggtgggcgtgggcatttcagatgctccttgaagaagtggcgcaaccgagcttagagctgctcggtctcgcggtagtcgtcggtgtcgtagtccacgtcgccgaacgaatccacgacgtgcgccgggtcaaaggaaggcgcgctgtccttcaggcccaggcccattccggcgagcttcatcttgacctcgtcgatggacttctggccgaagttccggatgtccagaagatcggcctccgtacgccctatcaactcgcccacgctgttgatgccctcgcgcttgaggcagttgtacgaacgaacggtgaggtccagctcctcgatcggcagcgccaggtcggcagcgagctgcgcgtcctgcggcgacgggccgatgtcgatgccctcggcggtctcgtccagctcccggcacaggccgaagagctccaccagggtcgagccggccgaggccagcgcggtccgcggcgagatggacgccttcgactcgacgtcgatgatcagacggtcgaagtcggtgcgctgctcgacacgggtcgcctcgacgcggtaggtgaccttgagcaccggcgagtagatcgagtcgaccgggatccggccgatctcggcgcccgcgctcttgttctgcgccgcggtgacgtagccacggccacgctccacggtcagctccatgtcgagccggcccttgctgttcagggtggccagcttcaggtcggggttgtgcacggagacaccggccggcggctggatgtccccggcggtcacgtcgcccgggccctgcttgcgcaggtacatgctgaccggctcgtcgtgctccgagctgacggtcagttccttgacgttcatgaccagctcgaccacgtcctccttgacaccggggatcgtggtgaactcgtgaagcacgccgtcgaccttgatgctggtgaccgccgcgcccgggatggacgacagcagggtccgccgcagcgagttaccgagggtgtagccgaagcccggctcgagcggctcgatggtgaaccgggagcgggtttcgctgagcgactcttccgagaggctcggtcgctggctgatgagcacgctgttcttctttctgtcaggccaaccgctatttgatggccgtcgggcttgtccggcgccctcgcaggcgccggacaacttattacttggagtagagctccacgatcagctgctcctggacctgcgtgtcgatgaccgcgcgagccggaagcgtgtggatcaggatcttcatctcgctcgggatgggctccagccacgccggcaccggccgggacccggcctgggcctgcgcgacgacgaagggagtcatctccttcgacttctcgcggagcgtgacgatgtcgtgctccttcacccggtacgacgggatgtcgaccttgacgccgttcaccaggaagtggccgtgcttgaccagctggcgggcggcgtcgcgggacgcggcgtagccggcccggtagacgacgttgtcgagacgggactcgaggatctgcagcagcacctcaccggtcttgccgggcttggtgacagcctcctcgtagtaaccgcggaactgcttctcgagcacgccgtacacgcggcgggccttctgcttctcgcggtgctggagcaggtactcggtctccttggtccggccacggccgtgctggccgggcgggaagggacgcgactcgaacgggcacttcggcccgtcgcacttgctgcccttgaggaacagcttcatcttttcgcggcggcagcgcttgcagtccgcaccaacgtaacgagccattgcttctagatctccctcagacccgacgacgcttaggcggacggcacccgttgtgcggctgcggggtcacgtcggagatctgaccgacctccagaccagcggcctgcagcgaacggatggcggtctcccggccggaaccggggcccttgacgaacacgtcgaccttgcgcatgccgtgctccatggcgcgacgcgcagcggcctcggcggccagctgggcggcgaacggagtggacttgcgggagcccttgaagcccacctggccggacgaggcccaggagatgaccgcaccggtcgggtcggtgatcgacacgatggtgttgttgaaggtgctcttgatgtgcgcctgcccgtgggcgacgttcttgcgttccttgcgccggaccttcttgactgcggcccctgcgcgtgccttcggtggcataagtcagtgcgctcctattacttccgaccgggcttcttcttaccggcgaccgtgcgcttcgggcccttgcgggtacgagcgttggtccgggtccgctgtcctcgcacgggcaggcccttgcggtggcggatgccggcgtagcagccgatctcaaccttgcggcggatgtccgcggcgacctcgcggcgcaggtcgccctcaaccttgaagttggcctcaatgtattcgcggagcttgagcagctcctcttccgtgaggtccttggcgcgcttgttcaggtcgatcgccgtagcggtcaatgcttcgacggaccgggtgcgcccgatcccgaagatgtaggtgagcgcgatctccatccgcttttcgcggggaagatcgacgccgacgagacgagccattgctgggcgtactcctcgttgttgtcgcggaggtctgtacccgtcccatcccgcctgcccgggcgggccccggcctccgaccgggggtgcagctttgagaaacagctgggacgagcttattcagtggtgcggatcctgcgcgggttgatcagccctggcgctgcttgtggcgcgggtcggtgctgcaaatcaccatgacccggccgtgccgccggatgatccggcagttgttgcagatccgcttgacgctcggcttgaccttcacggtttgccttaactctcagtcagacgggacaaaatccccgcgacccgttatttgtagcggtagacgatgcgcccacgggtcaggtcgtacggcgagagttcgacgacgaccctgtcctcgggaaggatgcgaatgtagtgctgacgcatcttcccggagatgtgtgccaggaccttgtgaccattggcgagctcaacgcggaacatagcgttcgggagaggctcgatcactcggccttcgatctcgatggctccgtctttcttaggcatgtcctccgctacctgtacatcgggttctggggcaggctgtgcaacgccgtacccgagcctcttggtgggctcggaccagccgcggctccctcgttcctcgaagcgctgaggacatgaaagagtggacgctgcgcgccagcaagccagtctacgcgcacgtcccggggacgccaaactgaggtcaccgttacccggggtcgggcgtgtcacgcgcgtcgctagcgcccccggcggttgcgctcagtgagcgccccgaccgccgtgatgaccaccgggatcaagacccaggccggccagaagtagtacgcgtgaccggcggcgaccgacgtgatcgtccagatcagcgtgcacaccaggaaggcggacagggccgagccgaaggtgtgccgaccggtctgcgggtcctttttccacggctgctgcggaatcggcggggccagcgggtgcggctgcggcggcgggggcgccggctgcacctgggcgtgctgcaccggaaccgtgccgggcaggtcgtcgagcaggccgtcgagatcgccgtaggtccgggcggaataggcccgctggacccgctcgtcgtactcgttcaggtccaggcggccctcgtcgagcgcggacttcaactgatccgcgacccgctgacgatcactgtccgcggcccgcatcccctcgcgtcccatgggtcacagcatgccaggcgccggccaacggttacagaggctgtcgcgcggtcaccagatcgccgagacgggcccggccgccgtccagggcggtggtcacccacaccccgtcctccaacagcgccatggtgtgctccacgtgcgccgcgcgggatccgtcccgggtcaccacggtccagccgtcggagagctccacggtccgcggcgagcccatcgtgatcatcggctcgatcgccaatgccatgcccacgaccagccgcgggccacgccccggcttgccgtggttgagcacgtgcggttcctggtgcatctcggtgccgatgccgtggccaccgtagccgtcgacgatcccgtaccggccggccttgcggatcaccttctcgacgttgaacgagatgtcggtgagccgaccccggccgttcgcggcgccccgggcggccgcggcgatcccggcccacatcgcatcctcggccacctcggccatccgcagcagtgccgggtcggtctcgccgacgccgacggtgatcgccgagtcgccgtgccagccgtccaggatcgccccgcagtccagcgagatcaggtcgccctcggcgaggatctgctgggctcccgggatgccgtgcacgacctgctcgttgaccgaggcgcagatcgaggcggggaagccgtggtagcccttgaacgacgggatggcgccggcctcgcggatcgtcttctccgcgatggcgtccaggtcggccgtcgagacgccgggtgcgaccgcggcgcgcatcgcttccagcgcggcgtgcacgaccaggccggccgcccgcatcttctcgatctgctccggcgtcttcagctggatgtccagctcctgacgtcgcatctcagcccccgtacgaccgcagggcgtcgatcgcgcgcacggtgacgtcctcgaccggaccggtggcgtcgatgcccaccagcttgccctgggcgccgtagtagtcgaccagcggagccgtcttgtcggcgtactccaccaggcggttggcgatcgtctcggccttgtcgtcgtcccgctggaacagctccgacccgcaccggtcgcagatgttctccttgctggtcgggtcgaactcgacgtgccagatcttgccgcagccgcggcaggtccggcggccggagagccgccggatcacctcgtcgtcgtcgaccacgagctccatcaccagatccagcgcggtgccgaggtcggccagcagcttgtccagcgcggccgcctgcggcaccgtgcgcgggaacccgtcgagcaggaagccgtcgccggcgtccggctcggccaggcggtcccggaccatgttgatggtcacctcgtccggcaccagctggccggcgtccatgtagcgcttggcctcgacgcccagcggcgtcccctgcgacacgttggcccggaagatgtccccggtcgagatcttcggtacggcgaggtgggcggcgatgaactcagcctgggtccccttgccggcccccggagggcccaccaacaccagccgcacctacatcgcctcgcttcgctcgcaagaagccacgcctaccgccgccagagccccccggctccgcgtacccactaccggaggaacccttcgtagttccgctgcatgagctggctctcgatctgcttcaccgtctccagacccacacccaccatgatcagcacagcggtgccaccgaacgggaagttctggtactgcttctggtccagccagatgaagaagaagttcggtaggaccgagatcagacccaggtacagcgcgcccggcagggtgatccggctgaggatgaagtccaggtagtcggcggtcggcttgcccgggcggatacccggcacgaaaccaccgtacttcttcatgttctccgcgacctcagtcgggttgaacgtgatcgacacgtagaagtacgtgaagaagatgatgagcaggaagtacacggtgatgtagagccagctggtcggcgtcgccagccagttctggatccagatctggtagtccttcagcgtgttcttgttgaagaactgcaggtacagctgcggcaggtagagcagcgacgacgcgaagatgaccgggacgacacccgcctggttcaccttgagcgggatgtaggtggaggtaccgccgtacatccgccggccgatcatgcgcttggcgtactgcaccgggatgcgccgctgggcctgctcgatgaagacgaccagcgcgatgatcaccaggaccagcgcgatcaccaggaggaacttcgcggtgccggcggactgcttgatggtccagccctcaccggggaggcgggcggcgatcgaggtgaagatcaggacggacatgccgttgccgacgccgcggtcggtgaccagctcgccgagccacatgaccacaccggtgccggcggtcatcgtcatcaccaggacgctcagcgtcagccagatcgggatgccggtgttctccgggatgatctggaactgcgggttgtcctggtcgcagaggccgccgaacagctgcccggtgcgggccagcgcgacgaacgccgaggactgcaggatcgccaggccgagcgtcaggtaccgggtgtactgggtgatcttcgcctgaccggactgaccctccttgcggagctgctcgagccgcggaatcaccacggtcagcagctgcaggatgatcgacgcggtgatgtacggcatgatgccgagcgcgaagaccgagagctggaggagcgcgccaccggagaacaggttcaacaggttcagcacctggttgccggactgctcttcgatcttcagacaagcctgcacgttgtggtacgacacaccggggctgggcagcgtggcgccgagccggtagagcgcgatgatcgccaccgtgaacaacaacttcttgcgcaggtcaggcgtccgcaacgcactcgaaaaggcggagagcaacttcttcctcctgcgcgaggtaaccgcacgtttggcggtatggggggaaggcatcggtccggatgaccgatatccctagctgggaacggactctaacagtcttggcccgccgtggtcagccacggtagcggggcaagcggcacaacgtcacgagccgacacaaaagtgcaggtcagacgcgggaaggggatgctcgtccgaacagcgtgtccggacgagcatccccgcaagcctcacagctcggtggtggaaccaccagcggctgcgatcttctccttggcggactcactgaacgcgtgcgccgagatcgtcagcgacacgccgcccagctcacccgagcccagcaccttcaccggctggttcttgcgaaccgcaccggcctcgacgagctcggacgggccgacctcgccaccgttcgggaacagctcggccagcttgtccaggttgaccacctggaagatgaccttgttccgcgggcggttcttcaggcccttgatcttcggcaggcgcatgtggataggcatctgcccaccctcgaacgacgccggagtgttcttccgggcgccggtgcccttggtaccgcgaccggccgtcttgcccttcgagccctcaccacgacccacgcgggtcttcttggtcttggcgccgggggccggcttcaggtcatgaatcttgatcgccattactcgacctcctcgacagtgacgaggtggttcacggcgaagatcatgccccgaatttcgggacggtcctccttgaccaccacatcgttgatccgcttcaggccgagcgaccgcagggagtcccgctggttctgcttacggccgatctcggaccggatctgggtgaccttcaagcgcgccatcagtgcaccgccgcttccgcacgcgccgccagcatcgcggccggggccacgtcctcgaccggcaggctgcggcgagccgcgacctgctccggggactcgaggcccttcagcgccgccacggtggcgtgcacgatgttgatcgggttcgaggagccgaggctcttcgagaggatgtcgtggatgcccgcgcactccagcacggcgcgcaccgggccaccggcgatgacaccggtaccagcggacgccggcttgagcaggacgacgcccgcggcagcctcaccggtgatcgggtgcgggatggtcgcaccgatccgcggcaccttgaagaagtgcttcttggcctcctcgacgcccttggcgatcgccgcgggcacctccttggcctttccgtaaccgacaccgacggtgccgtcaccgtcgccgacgatcaccagggcggtgaagctgaagcgacgaccacccttgacgaccttggcgacgcggttgatcgcgacgacccgctcgaggtgcggggtcttctcgacgggcgcgttaccgcggccgccctcgcgacggttgtcccggcggccgccaccttcggtgttaccgccggacccgccgccacggcgctgctgaccaggcattggtcaatccctcctagaactcgagtccggcttcgcgagcggcatcggcaagcgcggcgatacgccccgcgtacttgttgccaccgcggtcgaagacgaccttggaaatacccgcggccttggcgcgctcggcgaggagcgcaccgaccttgccggcctgcgagctcttgtcgccctcggtgccccggatcgaggtgtcgagggtcgaggccgaagccagcgtgtggcccttgaggtcgtcgatgatctgcgcggtgatgttccgcgtggaccgggtgacgaccaggcggggacgctcggccgtgccgcgcacgttcttgcggacccggaagtgccgacgcgccttgccaacggcccgccgggaggcgatgccgccgccattgcggcgcttgagcagcgtggcggtcacttcttacctgcctttccagccttgcggcggatgacctcaccctggtacttgacgcccttgcccttgtagggctccggcgggcggatcttccggatgttggcggcgacctcgccgaccagctgcttgtcgatgcccgccacagtgaactgggtgggcttctcgaccgagaaggtgatcccggccggcggcacgatgttcaccgggtgcgagaagcccagagcgaactccaggtccttgcccttcgcggtgacacggtaaccggtgccattgatctcgagggtcttcttgtagccctcggtcaccccgacgatcatgttggcgaccagggtgcgcgagagaccgtgcagctccttggccttgcgctcgtcgttcgggcggttgacgaccagctcggcgccctcctgggacaccgtgatcggctcggccacgatgtgcgagagctcgcccttggggcccttgaccttgacggtctgccccgtgatggtgacatcgacgccggccgggaccgggatcgacttacgtccgattcgcgacatgtcaaagtctccagttaccagacgaaggcgaggacttccccgccaacgctccgcttgcgggcctgcttgtcggtcagcagtccctgggacgtcgaaatgatcgcgacaccgaggccgccgagcacgcggggcagctcgtcggacttggcgtaaacccgcaggccgggcttcgagacgcgcttgatgccggcgaggctgcgctcgcggttctggccgtacttgagctcaacgaccagacgcttgccgaccgcgccctcctcgggctcctcagacgtccaggacgcgatgtagccctccgccttgaggacctcggcgatgttcgccttgatcttcgagtacggcatggtcaccttgtcgtggtacgcctggttggcgttgcgcagacgcgtcagcatgtctgcgatcgggtccgtcatcgtcatgggtattcgtcaacctttctcgccggggttcccacgtgacacgcgggcctacggcgaagcggtattactaagtcggttaccaggaggccttggacacgccgggcagctcaccacggtgagccatgtcccgcacgcaaacccggcacaggccgaacttgcggtagaccgagtgcgggcgaccgcacttctggcagcgggtgtaggcgcgcacggcgaacttcggcttcgcggcagccttgatgatcagcgccttcttcgccatgctcagttctccttgaacgggaagcccaggagcttcagcagcgcccggccctcgtcgtcggtcgaggcggtggtgaccaccgtgatgtccatgccccgcgggcgatcgatcttgtcctggtcgatctcgtggaacaccgactgctcggtcagaccgaaggtgtagttgccgtgcccgtccagcttgcggccgtcgaggccccggaagtcacggatacgcggcagggagatggacagcagccggtccaggaactcccacatccggtcgccccgcagggtgaccttggcgccgatcggcatgccctcgcggagcttgaactgcgcgatcgacttggtcgcccggcggatcagcggcttctgaccggtgatcgtggtcaggtcgcggaccgcgccgtcgatgagcttggcgtcgcgggcagcctcgccgacacccatgttcacgacgaccttgaccaggccggggatctgcatggggttggcgtacttgtgctgctcctgcagcgccgggatgacctcggcccggtacttgctcttcaggcgcggcagcgccttcgtctcagtggcggcagtcatcacagttccttaccggtcgtacgcgcgatccggaccttgttgccgttctcgtcgatccggtaaccgatccgggtcggcttcccctggtcgtccacgatctgaacgttggagatgtggatcgcggcctcctgggtcacgatgccaccggtcttcgaaccacgctgggtggtgcggatgcgttcgtgcttcttgactcggttgacgccctcgaccaggaccttgtcccgcgccgggaaggccgcgatgaccttgcccttggcgcccttgtccttaccggcgatgacgacgaccgtgtcgcccttcttgatcttcacggtcagagcacctccggcgccaggctgatgatcttcatgaaccgcttgtcgcgcagctcgcgcccgaccgggccgaagatgcgggtaccgcgggggtccccgccgtccttgatgatgacggcggcgttctcgtcgaagcggatgtacgagccgtccggacgacgccgctccttgctggtgcggacgatgaccgccttgacgacgtcacccttcttcacaccggcgccggggatggcgtccttgaccgtggccacgatgacgtcgccgatgctcgcgtaacggcgaccggagccaccgagtacgcggatgcacaggatctcccgggcacccgtgttgtcggcgacgcgcagtcgcgactcctgctggatcacgtctgtctcctatgtctgccagttctccggtgaccaccgaagcttggcggaacgatggtccgctgggccggccatagccggcccagcgtactcacttggccttttcgaggatctccacgatgcgccaccgcttggtagcggacagcgggcgggtctccatgatcgaaacccggtcgccggtgccggcggagttctgctcgtcgtgcaccttcagcttgcgggtacgacggatgaccttgccgtacagcgcgtgcttgacgcggtcctcgacctcgacgacgacggtcttgtccatcttgtcgctgaccacgagaccctcacgcaccttgcgctgggcgcgcggcgcaacagtgttctcactcatgcgctcacctcatccggcgcaaccgagagccccagctcgcgctcacgcatgatcgtgtagatcttcgcaatgtccttgcggacgacctgcagtcgacggtgattgtcgagctggccggtcgcgcgctgcacgcgaaggttgaacagctcagccttggcctcccgcagcttcgcgatcagctcctcgtcggagctctcgcgcagctcggctgccttaacgcccgctgccatcagctttcacccacttcgcgcgtcacgatgcggcacttcatcgggagcttgtggatcgcgcggcgcatcgcctcacgcgcgaccgtctcgttcgggaaggacatctcgaagagaatccggcccggcttgacgttcgccacccaccactcgggagaacccttaccggaacccatgcgggtttcggccggcttcttggtcagcgcctggtccgggaagatcgagatccagaccttgccgccacgcttgatgtgacgggtcatcgcgatacgcgccgactcgatctgccggttggtcacgtacgccggctcgagagcctggataccgaactcgccgaagacgacccggttgccgcccttggacgcgccgtggcggtccgggtggtgcggcttacggaagcccttcgggggcttacgcggcatcagcatgtgtcagccctcctgctgcgtttcggccggagccggagccgcggcaaccgcggcgtcgttcgcgttgtcgccgtccgcggtggaccgggactgggccgcggcacggcccgcctcggtgccacccgcggtcgtgccggacgaaccggaacggccacggcgcggacgctcgggacgctcggcgcggtcacggcgcggacgcgccggcgcctcggccacggcctcgcggccgggaacggcgtcgcccttgtagatccagaccttcacgccgatccggccgaacgtggtacgggcctcgaagaagccgtactcgatgttggcccggagcgtgtgcagcggaacgcgaccctcacggtagaactccgtgcggctcatctccgcgccgccgaggcggccggagacctgcacccggatgcccttgcagatcgggttcttcatggccgactgcatggccttgcgcatcgcccggcggaagctgacccgggaggacagctgctcggcgacgccctgggccaccagctgcgcgtccgactcggggctcttgacctcgaggatgttcagctggacctgcttgccggtgagcttctcgagctcgccgcggatccggtcggcctccgcacccttacggccgatgacgatgcccggccgggcggtgtggatgtcgacccggacccggtcgcgggtccgctcgatgtccaccttggagatgccggcacgctcaagacccttggacatcatccggcggatcttgacgtcctcgccgatgtagtccttgtagagcttgtccgcgaaccagcggctcttccagtcggtggagatgccgaggcggaacccggtggggtgaaccttctgacccattactcggcaccctccgtgctctgggactcggcagcctgcggctcagccggcttggcagccttcttcgccgtggccttcttcgccgggcgggccacctggaccgcctcgaccgcgatggtgatgtgactcgtacgcttgcggatccggtacgcccggccctgcgcccgcggacggaaacgcttgagcgtgggaccctcgtcgacgaacgcctcgctcacgaggagtgcgtcggggtcgagccgctcgttgttctccgcgttcgccacggcgctggcaagcaccttgtagacctgctcgctggcggcctgcggcgcgaactgcaggacggtcagcgcctccttcgcgggcagaccgcggacgaggttgaccacccggcgcgccttgttcggcgagatgcgcacgtgtcgcgcaaccgcccgcgcgcccggaagcaccggagcgtcgccctttgctggcatcgctgtagctccttgatcctctaatccgtgtatctgcttagcgacgacggctcttgcggtcgtccttctcgtgacccttgaacgtgcgggtcagagcgaactcgccgagcttgtgcccgaccatcgcctcggtgacgaacaccgggacgtgcttgcgcccgtcatgcacggcgatcgtgtgcccgagcatgtccgggatgatggtcgaacgccgcgaccaggtcttgatgacgttcttcgagttcttctcgttctggacttccaccttcttgagcaggtggtcgtcgacgaacgggcccttcttcaggctgcgaggcatcttcttctactcccgttacccgcgcttgcgggtggcgtagcggcggcgaacgatcagcttgtcgctcggctggcccttgcgacgggtacggccctcgggcttacccgccgggttcaccgggtggcgaccacccgaggtcttaccctcaccaccaccgtgcgggtggtcgacagggttcatggcgacaccacggacggtcgggcgcttgcccttccaccgcatgcgaccagccttgccccagttgatgttcgactgctcggcgttgccgatctcaccgacggtggcgcggcagcgcacgtcgacgcgacgaatctcgccggagggcatacgcagcgtggcgtacacaccctcacggcccaggagctggatgccgacgccggccgaacgggccagcttggcgccaccgccgggacgaagctccacgttgtggatcgtcgtaccgaccgggatgttgcgcaggggcaggttgttgcccggcttgatgtcggcgccgacgccggactcgacgcggtcaccctgcttcaggtccttcggcgccacgatgtagcgcttctcaccgtcggcgtagtgcagcagcgcgatgcgggcggtgcggttggggtcgtactcgatgtgagcgaccttggccggcacgccgtccttgtcgttccgcttgaagtcgatcagccggtactgccgcttgtggccaccgccctggtgccgcgtggtgatgcggccgtggacgttgcgaccacccttcttgggcagcgggaccagcagagacttctccggggtggaccgggtgatctcggcgaagtcggcgacgctcgagccgcgacggcccggcgtggtcggcttgtacttacggatagccatgattcacaaaccccttagctgaccgggccgccgaaggcctcgatacggtcaccgtcagccagcttcaccatcgcgcgcttggtcgccttgcgctgaccgaaaccggtcttggtgcgcttgcgcttgccctcgcggttcgcggtgttgacggtcagcacgcggacgttgaagatctgctggatcgcgatcttgatctgcgtcttgttggcgtccgggttgaccaggaaggtgtaccagttctggtcgagaacgctgtagctcttctcggagaccaccggggcgacgatgatgtcgcgcgggtcggcgatcgtgctcacttgtcgccctcctcggacgtctcggacccgcccaggaactcgtcgagcgcgaccttggtgaagaccacctcgtcggcgaccagcacgtcgtacgtgttcagctggccggcctcgatgaggtgcacggtcggctcgttgcgcagcgagatccagttcagctcgtcctggctgtccagcacgacgagaaccttggtggtctgcgccaccttccgcagcgtggcgacggcggccttggtcgacggcgtctcgccgctgacgaaggactcgacgacgaacacgcggccgtcgcgggcccggtcggagagggcgccacgcagggcggcggccttcatcttcttcggggtccgctggctgtagtcacgcggcacgggaccgtgcacgacgccaccaccggtgaactgcggcgcgcggatcgagccctgacgggcgcgaccggtgcccttctgcttgtacggcttcttgccgccgccggcgacctcgccgcgggtcttcgccttgtgcgtgccctggcgggccgcggccagctgggccacgacgacctggtgcatcagcgggatgttcgcctgcgcgtcgaagacgctggcgggcaggtcgaccgagccggccttcgcgccctcggcgttgatgatgtccaccgagctcacttgacaccacccttcttggccgcggtacggaccaggatcagcgcgcccttcgggccgggcacagcgccgcggaccaggatcaggttgcgctcggtgtcgaccgcctgcaccgtcaggttctgcacggtgtagcgcttgccgcccatgcggccggccatcttcacgcccttgaagacgcgacccggggtcgcgcaggcgccgatcgagccgggcgagcggtgcttgcgctcgacaccgtggctggcccgcagaccgtggaagccgtgccgcttcatgacaccggcgtagcccttgcccttggtcttaccggtgacgtcgatcgcggtacccgcggcgaacgcctcgacggtgacctcctggccgagctcgtactcggaggcgtcgacggtacgaagctcgacgatgtggcgccgcggcgacacaccggccttcgcgtagtggccgctctcgggcttgttgaccttgcgggggtcaatcgcgccgtaggccagctggacagccgagtagccgtccttctcgtcagtacggacctgggtcacgacgcacgggccggcctgaaccacggtcaccgggacgaccttgttgttgtcccagacctgggtcatgccgagcttggcgcccaggatcccctttacttgcctgtccatttgtccggatccctacagcttgatctcgatgtcgacgccagccggcaggtcgaggcgcatgagcgagtcgaccgtcttcggagtcgggtcgatgatgtcgatcagacgcttgtgcgtgcgcatctcgaagtgctcgcgcgagtccttgtacttgtgcggcgaacggatcacgcagaaacggttgatctccgtgggcagcggcaccgggcccgcgacctgcgccccggtacgcgtcaccgtctcgacgatcttccgcgccgaggagtcgacgacctcgtggtcataggccttgagccggatgcggatcttctgtcccgccatggtggcttctgtttccttctctcgatgccgctacgtgcggaggcggtggcccccacatgcccgcaggaccgttgatcctgcgttgtccgacccccgcggtcgggcgtgtcgcgcctcgtcacagagtgctgggcactcagctttcggcctccatccccgatcttgccggggacgaacgcgatcgcggggatctgagggcgccgggcggctggaaacacacccggacacccggcgagggtgggcggctgacgaacgccagccacccaccccgcgcggacgcaacctgactagtatgcccgattgaacgcagcattgctaatcggggtcaccggtgggggttgtcaccggctctcaccggcgacaacccgcaatcacttggtgatcttcgtgaccgtgccggcgccgacggtgcggccaccctcacggatcgcgaacttcaggccctgctccatggcgatcggctggatcagcttcacggccatcgaggtggagtcgccgggcatgaccatctcggtgccctcgggcagcgtgacgacgccggtgacgtccgtggtgcggaagtagaactgcggccggtagttctggaagaacggggtgtgccggccaccctcctccttcgagaggatgtagacctggccctcgaactccgtgtgcggagtggaggtgcccggcttcacgacgaccatgccgcgctcgacgtcctcgcgcttgatgccacgcagcagcagaccgacgttctcacccgcgcgggcctcgtcgagcagcttgcggaacatctcgatgccggtgcagacggtcttggtcgacttctcgcggataccgacgatctcgacctcctcgttcggcttgaggatgccgcgctcggcgcgaccggtcaccacggtgccacgaccggtgatcgtgaagacgtcctcgatcggcatgaggaacggcttctcggtctcccgctcgggctgcgggatcgcggtgtcgaccgcgttcatcagctcgagcagcttgccggtccactccgggtcgccctcgagcgccttgagcgccgacacgcgcacgaccggcaggtcgtcgcccgggaactcgtaggtgctcagcagctcgcggacctcgagctcgacgagctccaggagctcctcgtcctcgaccatgtcgctcttgttcagggcgacgacgatgtacggaacgccgacctggcgggccaggaggacgtgctccttggtctgcggcatcgggccgtcggtggcggccacgaccaggatcgcgccgtccatctgggcggcaccggtgatcatgttcttgatgtagtcggcgtggccggggcagtccacgtgcgcgtagtgacgcgccgcggtctggtactcgacgtgcgcgatcgagatcgtgatgccgcgggccttctcctccggcgccttgtcgatctcgtcgaacggggtgtacgggttgagctcagggaactcgtcgtgcaggaccttcgtgatggccgcagtcagcgtcgtcttaccgtggtcgatgtgaccaatggtgccgatgttgacgtgcggcttagtccgctcgaacttcgccttcgccactggtgtcctcctgtggactgatcattacttttcgcccggcacgccgataaggcgctcaggactctgtcgactgctcgtgcacgtgcggccctcgacgggccgcacgtgcctcaacgcgtcaggcgccggtggccttagcgatgatctccttcgccacgttctgcggaacctcggcgtaggagtcgaactgcatgctgtagctggcccggcccgcagtcttcgaccgcaggtcgccgacgtagccgaacatctccgagagcggcaccagagccttcacgacgcgggcgccgtgacgctcctccatcgactggatcatgccacgacgggagttgaggtcgccgatcacgtcacccatgttgtcctcaggggtggtgacctcgacggacatcatcggctccagcagcgcgggatcggccttgcgggccacctccttcatcgccatggagccggcaatcttgaacgccatctcggacgagtcgacctcgtggtactgaccgtcgaccagcgtgaacttcacgccgaccagcgggtagccggcgaggacgccgtactggagggagtcctgggcgcccgcgtccaccgaggggatgaactccttggggatgcgaccaccggtcaccgcgttcacgaactcgtacgtggggccgtccgcctcgagcgacagcggctcgacgttgacgacgaccttcgcgtactggcccgagccaccggtctgcttcttgtggacgtacgtgtgcttctccacggtgccgcggatcgtctcgcggtacgccacctgcggcttgccgatgttggcctcgacgttgaactcgcggcgcatgcggtccaccaggatgtccaggtggagctcgcccatgccggcgatgatcgtctggccggtctcctcgtcgttgaagacgcggaaggtcgggtcctcctcggccaggcgctggatcgcggtgcccagcttctcctggtccgacttggtcttcggctcgatggcgacctggatgaccggctccgggaaggtcatcgactccaggatgaccgggttcgccgggtcgctgagcgtgtcaccggtggtggtctgcttcagaccctggacggcgatgatgtcgccggcctgcgcggtggcgcgctcctcacgcttgttcgcgtgcatctggtagatcttgccgatccgctccttgcggtccttggtggagttgaccacctgggaaccggagtcgagcgtgccggagtagacccggacgtaggtcagcttgccgaggtgcttgtccgtctggatcttgaacgccaggccggagaacggctcgtcgttcgacggcttgcgcagcatcggggtctcgccgtcggtcgcggtgccctcgatcgccgggatgtccagcggcgacggcaggtagtcgacgacggcgtcgagcatgggctgaacgcccttgttcttgaacgccgagccgcacaggaccgggttggccttgctggcgatcgtggcgcgccggatggcggcccggatctcgtcgatggagacctcttcgccttcgaggtacttctccatcaccgcgtcgtcgacgtcggccagcgtctcgaccagcttctcgcgccactcgttcgcggagtcgaccaggtcggccgggatctcctcgatcgcgtagtcctcacccttctgggtctccccgcgccaggtgagcgccttcatgttgatcaggtcgacgacgccgatgtggtcggcctcgagcccgatcgggatctgcagaacgagcggcgtggcgttgagccggtcgatcatcatctgcacgcagcggaagaagtccgcgccggtccggtcgagcttgttgacgaagcacatccgggggacgtggtacttgtcggcctggcgccagacgttctccgtctgcggctccacgccggccacaccgtcgtacaccgcgaccgcgccgtcgagcacgcgcagcgaccgctcgacctcgaccgtgaagtcgacgtggccgggcgtgtcgatgatctggatcgtgtagcccttccactcgcacttcgtggcggcggaggtgatggtgataccgcgttcctgctcctgctccatccagtccatgacggcagcgccctcgtggacctcaccgatcttgtacgtgatgccggtgtagaacaggatccgctcggtcgtcgtggtcttaccagcgtcgatgtgcgccatgatgccgatgttgcgaaccttggcgagcgcgtctgcggcggccacttccatccctacttttcttcgtcgtcgtctcgtggaccggtacgactgccacggcccggcgtgcagccgggcctcagcagggtcttaccagcggtagtgcgcgaaggccttgttggactccgccatcttgtgggtgtcctcacgacgcttcaccgcggcaccgaggccgttgctggcgtccagcagctcgttctgcagccgctcgatcatggtcttctcccggcgggccttggagtactgcaccagccagcggagaccgagggtggtctggcgcggcgtgcgcacctcgaccgggacctggtaggtcgcgccaccgacgcggcggctgcggacctcgagggtcggcttgacgttgtccatcgcgcgcttgaggatgaccaccgggtcggtgccactcttctcgcgggcaccctcgagggcgccgtacacgatgcgctcggcgagctgacgcttgccgccgaccaggatcttgttcaccagctgggtgaccagcggcgagttgtacaccgggtcagcgaccaccgggtgacgctgagcggggcccttacgcggcatgtcagctcttctccttcttcgcgccgtaacggctgcgggcctgcttgcggttgcggacaccctgggtgtccagcgaaccgcggacgatcttgtagcggacgccgggcaggtccttcacacggccgccacgcacgagcacgatcgagtgctcctgcaggttgtggccgacgcccgggatgtacgccgtgacctcgatctggctgctcagcttcacgcgagcgaccttgcgcagcgcagagttcggcttcttgggggtggtggtgtacacgcgggtacacacgccgcgccgctgagggcttcccttcagtgccggcgtcttcgtcttggtcgtcttcgcctggcggcccttgcggaccagctgctggatcgtgggcaccgggtttctccgctcccttcggccgcttcctgtttacggccgcaccgagtgttctgcctgtgtgcgaggcgctccagggaggagcgtcccgcacccgcggtcgggcgtgtcgtccggctcacggtcccgctacgcgtgatgagcccacgcgtaccggatcttgtctttgtcagggcaagggttctcgccgaaccctgcccgtcgtgcggcaatacccgtcgtacgttccgattcgggtgcacgcacgagttgcccgggcgagcccgggcacgaggggaaagagtacccaccaagggcacccaggtcaaaatgaccgtgtcaaatcgactgtgtcaccagaccgggctcccacgatggacatctccgtataccagtgtaccgggtgcccctccgcgacaacgccgcggtgccggatccaccgttaccggccctcaagaagtctgcaacaccactcccagcaccagagcaagcaacgatattcccgagccggcggcgccacaggcgatcccggagatcgccagcccgcggccggtgaaccggacccggcccgggccaccggagcgcttgatctgccgcatcgcgatcaccgcggcggtcaccgctcccccgccggccagcacactgagcaggctgaaggcgccggccacccacgcgctcgcgccaccgaacccgaagcaggcggtgatcaacgcgaccaggatcgagccgatcccgacgatcagggaaccgatcgccaggcccgacgtgatcggcacgacacgcagctggaccaggccgaagtcggtgccactcaccacgtcgacccgctccggctcccagcctgcgccggccggcggcggcgggaccggcgcgccgtaggacggcggaccgtacggcaggggcggcggcggctgcatcatggtctgaagcatgtcacccggacgagcgggcgcgcagcccggccctcggccggcggctcagtcggtgcccggggagaactgctgaccggccggggtggcggccaggtgcagcagaccggcgatcaacgccaccaccagggcggtcagggccagcaccaggccgccccaggcgagcctgcggccgcggcggatccacgcgcccccggtgaggtagccaccggccgcgtaggcctcacgggccgtctgacgggccagcagcaacgccaccgtggccgggatcacgccgccgacgagcgggccggccagcagacccaccaggcccagcacgaagacggcgcgcgccttcgtggacggggccggttccggatccagcggatggcgggtcggcactgcttcaacggtcacccgaccatcttagaaaccccgaagggcggccgcgcgtgtgcgcgaccgccctccggcatgcagaacccttagcggtacgacccgaagtcgaagtcgtccagcggcacagcctgcccgctggccggcccgaagccgtagtcggtctccgggtacccggtcatcgagtacaccttggccttggcctcctcggtgggctcgacccggatgttgcggtacttggagataccggtaccggccgggatgagcttgccgatgatgacgttctccttgaggccgaccagcgagtcgctgcgcgagttgatcgccgcgtcggtcagcacccgggtggtctcctggaaggaggccgccgagagccaggagtcggtggccagcgaggccttggtgatacccatcagcaccggacgaccggcggcgggctcgccaccctcgcccacgagtcggcggttctccgactcgaagagcgcccggtcgaccagcacgcccgggaggaactcggtcgcgccggagtcgatgaccgtcacccgcttgagcatctggcggatgatgatctcgatgtgcttgtcgtggatgagcacaccctgcgagcggtagacctcctggacctcactggtcaggtggacctggaccgcgcgcgggcccatgatgcgcagcagctcgtgcgggtcgatggtgccctcggtgagcttctcgccgacctgcacgtggtcgccatcgtgcgcccgcagcttgacgcgcttggagatcttgtcgtagacgatctcctcgctgccgtcgtccgggatcacgatgatcttccgcgaccgctcgccgtcctcgatccggatgcgtccgggggtgtcggcgatcggcgccttgcccttcggcacccgggcctcgaagatctcctggacacgcggcagaccctgggtgatgtcctcacccgcgacaccaccggtgtggaaggtacgcatcgtcagctgggtacccggctcaccgatggactgggccgcgatgatgccgaccgcctcgccgatgtcgaccgacttgccggtcggcaacgaacggccgtagcaggccgcgcagacgcccagcttcgactcacaggtcagcacgctgcgcacccggacgttctcgacaccggcggcgaccagctggtcgacgatgatcgagttcaggtccgtaccgcgggcgacgaccaggttgccgttcgggtcgctgatgtcgtcggcgatggtccgggcgtgcacgccggtctcggcgtgggtgtgcacgaccagggtgccgtccggctcgcgctcgccgaccgccatcgggatggcgcggtcggtgccgcagtcctcctcgcggatgatgacgtcctgcgagacgtccaccagacgccgggtcaggtaacccgagtcggcggtccgcagcgcggtgtcggccagacccttacgggcaccgtgggtggagatgaagtactccagcacggtcagaccctcgcggtacgacgaggtgatcggccgcgggatgatctcacccttggggttggccaccagaccacggatcgcggcgatctgccggagctggagcaggttaccgcgggcgccggagttgatcatcacccagagcgggttctcctgcggcagcgcggtctccatctccttggagatctcgttggtcgccttggtccagatctcgatgagctcgccgcgacgctcctcggcggtcatcagaccacgctggtactgcttgtcgatccggtctgcctcgacctggtagcgggccaggatctccggcttgcgcgggggaccgatgacgtcgcccatgccgatcgtcacaccggaccaggtggcccagtggaagccggcctccttgagcgcgtccagggtcgcggccagggcgaccttggggaagcgctcggcgaggtcgttgacgatcgccgacagctgacccttgcggatctcgtagttcacgaagcggtagcccgggggcagcgtctcgttgaagatgacccggccgagcgtggtctcgacgagcagcggctcgccctcgacccactcctccggcgcctcccacgcggcctgcttggccccgttgtcgacaccgatgacgtcccgcagccggatcttcaccggggcctgcaggtgcagctcgccgttgtcgaacgccatccgcgcctcggcgtccgagctgaacacccggccctcacccttggcacccgcggtgaggtgcgtcaggtggtacaggccgatgaccatgtcctgggtcggcatggtgaccggcttgccgtcggccggcttgaggatgttgttcgacgagagcatcaggatccgggcctcggcctgcgcctcggccgacagcggcacgtgcaccgccatctggtcaccgtcgaagtccgcgttgaacgcggtgcagacgagcgggtggatctggatcgccttgccctcgaccagctgcggctcgaaggcctggatgcccaggcggtgcagggtcggagcacggttcagcagcaccgggtgctcgctgatgacctcctccagcacgtcccacacgaccggacgctgacgctcgaccatccgcttggcggacttgatgttctgcgcgtggttcaggtcgaccaggcgcttcatcacgaacggcttgaacagctccagcgccatctgcttgggcagaccgcactggtgcagcttgagccgcgggccgacgacgatgaccgaacggccggagtagtcgacgcgcttgccgagcaggttctgacggaaccggccctgcttgcccttgagcatgtcggacagcgacttcagcgggcggttgcccgggccggtgaccggccggccgcggcggccgttgtcgaacagcgcgtcgacggcctcctgcagcatccgcttctcgttgttgacgatgatctcgggcgcgccgaggtcgatcagccgcttgaggcggttgttccggttgatcacccggcggtacaggtcgttcaggtcggacgtggcgaagcggccaccgtcgagctgcaccatcgggcgcaggtccggcgggatgaccgggacgcagtccaggaccatgccgagcggcgagttgcgggtgttcaggaacgccgcgacgaccttgagccgcttgagcgcccggatcttccgctggcccttgccggaccggatgatctcccggaggttgtccgcctcggcgtccaggtccatgttctgcagcagggccttgatcgcctcggcgcccatgccaccggtgaagtactcaccgaagcggtcgcgcagctcgcggtagagcagttcgtcggtgaccagctgcttggagtcgagcttgcggaacgtgtcgagcacctcgtcgaggcggtcgatctcgcgctgggccttgtcccggatctggcgcatctcgcgctcgccggcttccttgaccttgcggcgcacgtccgccttggcgccctcggcctccagctcggcgaggtcctgctcgagcttggcggcccgcttctcgatctccgagtcgcggctgttctcggactgccgcttctccgcgaagatctcgttctcgatggtcgacatgtcgcggtgacgcgcctcggcgtccacgctggtgaccacgtacgaggcgaagtagatgatcttctcgaggtccttgggagccaggtcgagcagatagcccaagcggctcggaacacccttgaagtaccagatgtgggtgacggacgcggccagctcgatgtggcccatgcgctcacgccggaccttggaacgggtcacctcgacgccgcagcgctcacagatgatgcccttgaaccggacgcgcttgtacttaccgcagtagcactcccagtcccgctgcggaccgaagatcttctcgcagaagagtccgtccttctccggcttgagggtgcggtagttgatcgtctcgggcttcttgacctcgccgtgcgaccactgccggatgtcgtcagcagtcgccaggccgatgcgcaactcgtcgaagaagttgacgtcgagcacttggactatccctcgtgtttcgttgctcgggtgaattcaaggccggcgggggcggccccggtccgtcagaaccggggccgccaaccgtcagatctcttcgacgctgctgacgccctcgttcgggcgccgggacaggtcgatgccgagttcctccgcggcccggaagacctcgtcgtcggtctcgcgcatctccagggcaacaccgtcgctggagagcacctcaacgttcaggcacagcgactggagctccttgagaagcaccttgaacgactccgggattcccggctccgggatgttctcgcccttgacgatggcctcgtacaccttcacgcggccgagaacgtcgtcggacttgatggtcagcagctcctgcagcgcgtaagcggcgccgtaggcctgcatcgcccagcactccatctcgccgaaccgctggccaccgaactgggccttaccaccgagcggctgctgcgtgatcatcgagtacgggccggtcgaacgagcgtggatcttgtcgtcgaccaggtggttcagcttcaggatgtagacgtagccgaccgagatcgggtccggcagcggctcacccgagcggccgtcgaacagctgcgccttgccgtcgccgttgaccaggcgcttgccgtcccggttgaccagggtcgactcgagcagacccttgatctcctcctcctgggcaccgtcgaagaccggggtcgcgacgttgctgtcggcgggggactcgtgcgcctcgatcgagcggagctggcgcttccactcctcgtcgtcgccctcgatcgaccagccggtcttggcgatccacccgaggtgggtctccaggacctggccgatgttcatgcgcgagggcacacccagcgggttgagcacgatgtcgaccggggtgccgtcctccaggaacggcatgtcctcgaccggcaggatcttggagatgacgcccttgttgccgtgccggccggcgagcttgtcaccgtcctggatcttccgcttctgcgcgacgtagacccggaccagctcgttcacgccggggggcagctcgtcgccgtcctcgcgggagaacgtgcggacaccgatgaccgtgccggtctcgccgtgcggaaccttcagcgaggtgtcccggacctcccgggccttctcgccgaagatggcgcgcagcaggcgctcctccggggtcagctcggtctcgcccttgggggtgaccttgccgaccaggatgtcgcccgggacgacctcggcaccgatccggatgatcccgcgctcgtccaggtccgccagcatctcctcgctgacgttcgggatgtcgcgggtgatctcctccgggcccagcttggtgtcgcgggcgtcgacctcgtgctcctcgatgtggatcgaggtgaggacgtcctgctgcacgaggcgctgcgacaggatgatcgcgtcctcgtagttgtggccctcccagcacatgaacgcgaccaggaggttgcggcccagggccatctccccctcgtcggtgcacgggccgtcggcgatgacctggccggcctcgacccggtccccctcgaagacgaccggcttctggttgacgcaggagccggcgttcgagcgacggaacttgtgcagcaggtacgtgcggcggtggccgtcgtcctggtgcaccgtcacgtagtcggcgcacaggtcctcgaccacgccggcgacctcggcgacgaccacgtcaccggcgtcgaccgcggcacggtactccatgccggtgccgaccagtggcgactcggccttgaccagcggcacggcctgacgctgcatgttcgcgcccatgagggcacggttcgcgtcgtcgtgctcgaggaacgggatcatcgcggtggcgaccgaggtcatctgccgcggcgacacgtccatgtagtcgacctccgtgccgggcacgtagtcgacctcaccgcccttacggcggaccaggacgcggtcctcggcgaacgtgttgtcgctggacagcacggcgttcgcctgggccttgatgtaccggtcctcttcgtcagccgtgaggtagtgcacctcgtcggtgacgacaccgttctcgaccttgcggtacggcgtctcgatgaaaccgaacgggttgacccgcgcgaacgtcgagagcgcgccgatcagaccgatgttcgggccctcgggcgtctcgatcgggcacatccggccgtagtgcgacgggtgcacgtcccggacctcgaagccggcccgctcacggctcaggccaccggggccgagcgcgctcagacgacgccggtgggtcaggcctgccagcgggttcgtctggtccatgaactgggacagctgcgacgtaccgaagaactccttgatcgccgccaccacgggacggatgttgatcagggtctgcggcgtgatcgcctcgacgtcctgggtcgtcatccgctcgcggacgacgcgctccatccgggacaggccgacgcggacctggttctggatgagctcgccgaccgtgcgcaggcgacggttgccgaagtggtcgatgtcgtcggcctcgtagccctcctcaccggcgtgcagccggcagaggtactccacggtcttgacgatgtcttcctcggagagcgtgccccggacgatcgggacgtcgatctcgagcttcttgttgaacttgtaccggccgaccttggcgacgtcataccgcttcgggttgaagaagaggttgtcgagcagggtctgcgcgttctcccgggtcggcggctcgccgggacgcagcttgcggtagatgtctagcagggcctcgtcctgccccgcgatgtggtccttctccagcgtcgtcatgagcagctcggaccagccgaagcgctcacggatctggtcggcggaccaaccgatcgccttcagcaggacggtgacggcctggcgacgcttacggtcgatgcggacaccgacggtgtcgcgcttgtcgatgtcgaactccagccaggcaccccggctcgggatgaccttgacgctggtcaggtcgcggtcggaggtcttgtccggctccttggtgaagtacacgcccggcgaacggacgagctgactcaccacgacccgctcggtgccgttgatgacgaacgtccccttgggggtcatcatcgggaagtcacccatgaacacggtctggctcttgatctcgccagtggtgttgttggtgaactccgcggtcacgaacagcggggcacagtaggtcaggtccttctccttgcactcctcgatcgaggccttgacctcgtcgaatcgcggagccgagaaggacagcgacatggtgccggagaagtcctcaatgggactgatctcttcgaggatctctgcgaggcccgagtgggcgtgcgggtcgtccgtcgtccgggcctgccacgcctcgttgccgaccaaccagtcgaacgaatccgtctggagggcgaggaggttggggacctctagctgctcggtgatccggccgaaagagacccggcggggtgcgtaagcgctcgacgtacggctggtcttcgcagggcgggaagctgccaagatgcgtccttccgaggaccggtgctgctatgcggctgagttgctggtgcaactggtctgcgtgcactccaaaagacgcccgtcgaatccaaagacatggataaaacgataggcgtcaagatagaaggcagcgcacactagcagtgtagccgcttggctaaccgctgtccagcccacacccgaagtggctcgcggaacatgctctgacctcgccagagccgctcaagaaacgcggcgcaacttctccaggtgccggtccgtggtcgtcgagtcactcgatacccacggggcggctgtcgcaagcgcggaaacttgctgccatcagcgtgcctgtcagcggacactcagtcaagggctgtgccgcgggtcggatgcacccggtcgtccggccagcgcccgaaagggaccttactgcatggttatcgagctttgacatgctttgtcagccgggctccgactcgcccacgctgagcagcggcgacatcaccacgaaacatcgccaggggtcgagagacgccgatggcggagatccgggtcggatctccgccatcgagagaaaacgctgagaagcgtcagatcacttgagggtgaccttggcgccctcggcctcgagcttggccttggcggcctcggccttctccttgttgacgccctcgatgatggccttcggcgcggcctcgaccgcgtccttggcctccttgaggcccaggccggtcagctcacgcacgaccttgatgacctggatcttcttgccgccgtcgctctccagaacgacgtcgaaggagtcctgctcgacagcagcctcggccggagccgcagcggccgggccggcggcggcgacggccaccgcagccttgacgtcgaagacctcctcgaactgcttcacgaactcggagagctcgatcagcgtcatctccttgaaggcgtcgagcaggtcatcggtgctgagcttcgccatgatggcaacctttcctagcttctgatgtaaacgttgctcggttcgcgaggccgtcaggcggcctcggcggaaccgtccttctcgcgcttgtcacgcagggcgtccaccaggcgaacggcctgggagagcggagcctggaacgtggccgcggccttgctcaggttgcccttcatggcgccggccagcttggccagcagcacctcacgggactcgaggtcggcaagcttgctgacgtcctcggccgagatcgccttgccctcgaagacaccgcccttgatgaccagcgccgggttggccttggcgaaggcccgaagacccttggccgcctcgaccacgtcgccgctcacgaaggcgagcgcggtaggaccggtgaacagcgcgtcgaggccctcgatgcccgcgtcgccagccgcacgcttcgccagcgtgttcttggcgacggagtacttggcctgctggccgagcgaccggcgcagctcggtgagctgcttcacggtgaggccccggtattcggtcaacacggtggccgcggagtcacggaagttctccgtcagctcggcgacggccgtggccttgtcggcccggaccggcttgtccgccatgtccctcctctcctcagtgctattgccactggtcgaggggcccggaaaaagcaaaacgccccggcgcagggcacggggcggaaatccggcgcgctcgcgcgcaccgtcagatcacgaaccggtctccctgcgcaggtcgcccgctcttgcgggaccttcggccgcgacatccgtctcgcgacgggtgctgcggcgaccagcggtctatgggtggaacttcgagaatttaatgtacgcgggcggcacccgaaacaccaaatcggtgcccgcccgaccctcaggagcgggcccggcgcagccacccgtaggtggcgagcgcgaccgtgcaccaggccagcgaccagatcgtcagccgggccagctcggccgccggtggcacggcaccgtcggtcaggacccgggccacggccatcaccggcggcgccagccagggcgcgaacgagccgttcaggcccaggacgacgaccaggagcgagccggtcaccaggaccgccacgccgggcaggatgcgccgggtgaccgcccggccggacagggcgcccagggcgaccgcggccggcagcgcgagcaggtgggccagtacgccgagcaggatgccggccggcagagacgcctcggcggaccccggctctggaccgcggatcgcgtggaacgcccagggggtgagcatggcggcggcgcacaccgcggcgccggcgagcgtggcggccagcagaccggccaggccctcccggaccgggccgacggcgagccgggccaggcggcgctgcacgtccggctcggtgtccaggaccaccttggcgagccaggcgaggatcgggaacagcgcggcggcggaatagccgtaggcggtggcggccggggaggcgcccccgccgtagaggacgccgaggacgaccaggacggcgatcagcggggccagcacccggccgccgtgaaagaagccggccagacgcatccggatcagggcggtcaccgggcctccccgtccggcgtgcggtctgctcggggcggggagagttcatcgcgtacgccgtaatcggctctgtcccggacccgcagcacgtggtgaccggccgagcggagctggaccagcgtccgcgccgccgccgtgcgcggcacggcgatctcgaccacgacctcgtcccgctccgccaccaccgcgtccggctcccccgtgaccgcgcccggctcccccgtgaccgcctccggctcccccgcgaccgcgtcccggtccgtcccgaccggctgtgcgacggtgaccgcaccggcggcgaccgaccagtggatcgtgtccggcagcgtggtgatctcgccgcggtgatcgctgaccaggacgatgccgccggccgtggtgacctcggcgacgatctgcgggatcagcgtccgggcctgcgcgtcgagaccctcccagggctcgtcgaggaccagcaggccgggccgggcgagcagcgcctgggccaggccgaccttctgcgcggtgcccttggagagcgcggtgagcggggtgtcggcgtgctcgctcagcagcagccgctccagccagtgatcggccgcggtggccggcacccgtcggaccgcggcggtcgcccgcaggtaaccgagcgcggtgaacggctggtcggccgggaaacgctcgggcacccagccgacgaccggcggccggtcccggagcacgccgcggaccgggcgcaggacgccggcggccagttgcagcagggtggacttgcccgcgccgttcgggccgaggacgaccacgctgcggccgggatcgatcgtcacggacacgtcacgcagcgcccacggggcacgccgggcgtaccggaagccgaccccgtcgaaacgcatggccgcaaggatcgcacgaaaaagcccccgggatgaccccgggggcttcgacgatcagcgtgctcaggcgtcggcggactcgccgcgcaggttcttctgcgcgttcgggtcgaccgggacaccggggcccgtggtggtgctgacggttaccttcttcaggtacttgcccttggcggccgacggcttggcccgcaggacctcgtcgagcaccgcggcgtagttgtcgatcagctgctcggtgctgaacgacgccttgccgatgatcaggtgcaggttcgagtgcttgtccacccggaaggtgatcttgccacccttgatctcgttgaccgccttggtcacgtccaccgtgacggtgccggtcttcgggttcggcatcaggccacgcgggccgaggatgcgggcgatccggccgatcttggccatctggtccggcgtcgcgatcgcggcgtcgaactccagccagccaccctggatccgggcgacgagctcgtcggtgccgacctcgtcggcgccggccgcgagggcctcctcagccttcgcaccctgggcgaacacgatgacccgggcggtcttgccggtgccgtgcggcaggttgaccgtgccacggaccatctggtcggccttacgcgggtcgacacccagccgcatcgcgacctcgacggtggcgtcgaacttcgcggagctggtctccttcgcgagggcgaccgcgtccttcggctcgtagagcttgccgtcgtcgatcttcgccgccgcggcgcggtagatcttgctgcgctgtgccattactgattactcctgtggttgatggcggggcctggaacacgacccctcccactgaaaccgccgggaacccggcgatcagatcttggtgacctggttgaagttcagctcgaccggggtctcccggccgaagatcgacaccaggaccttgagcttctgctggtcggcgttgatctcgctgatcgacgccggcagcgaggcgaacgcgccgtcggtgaccgtgaccgagtcgccgacctcgaagtcgagcaccttgatctcgggcttcgccttcttctcctcggcctgcacggccggggccagccacttcagcacctcgtcgagcgagagcggagccgggcggtcgacccggtcggtggcgccgacgaacccggtgacccccggcgtgttgcgcacgcaggaatacgactccggggtcaggtccatccggaccaggatgtagccggggaagaccttggcctgcacctggttgcgcttgccgttcttgacctcgacctcttcacgggtcgggacctcgacctggaagatgaaatcctccatgtcgaggctggtgatccgggtctcgaggttggtcttgaccttgttctcgtaaccggcgtacgagtgcaccacgtaccagtcgccgggcgcgtaccgcagcttctgccgcagctccttgaccgggtcgtagtcctcgtcggcctcgggctcctgaaccgccaccggagtctcgtcggcctcctcgaccgactcgtcggtgatcggcgacgactgctcgtcagcaaactgcgcggtctcgtcgtcgtactcaggcacgctcgctcacttccagataagtcactcggtcgagatcggcgggctggctcacttaccgcccagggcgtggatcatgccctgcgcgaagccatagtccagcacaccgacgatcgccgtcatgatcgtgacgaaggcgatcacgacggtggtgtaggtcagcagctccttgcgcgtgggccagatgaccttacggagctcgctgatcacctcgcggaagaatccgccgatccgcccgaagaatccggtgcgcttgcgctccttcttcgtcttcggggagtcgtcgtccttcgtgcgctcggcgacggcggtgccaccgccgcggctcaccggggcgtcggcctcatcggcatcgtcaccgtcgacaacgtcggcgagcagctcgtcgtcgcccgggacgtcgtcaccgggccggtttttgtcggccacttcgccctacttccgtcgtcggtggtgatgattcccgtcagcactcgaccggacgcggactgtgcaaaccgcgcaccgggcgggcacgtcgaggaggattgcgcaggggtgacaggacttgaacctgcagcctgcggttttggagaccgctgctctgccaattgagctacacccctttgcgggaccgctgcctcgcggctcacagccccacggcgcaccagtgtacgggtacgcccttggttatcccaacccgggctaccgcttaccgataagcgcctgtgccagagacagtaccttgtccccgttgcacgtggcagtcagggcgagcctggtgtccccgtcctcagtgatctccttcaccgtcgcggtgaccaccacctcggtgccctcgtcggtgtccggcaccggcacgggccgggagaagcgaacgctgaactccttgaccgaatcgggtgcaccggcccaggcggtcaccgcgcggcccaccagggccatggtgaacatcccgtgcgcgatcaccccgggcaggccgacgccggtggcgatccggtcgctccagtggatcggattgaagtcacccgacgcccccgcgtaacgcaccaggtcggcacgggtgatccggaaggtctgcggctccagcacgtcacccatcaggcactctcctcgccgcgctgaaccagtttcgaccaggccgtgacgatcggctcgccggcctcggtacgcacctcggtgcggatggtgacgaaccagtggccgccacgggtggtgatctcgtcgaccgtgttcacacagaccaccgcgtcgccggccaccagcgggcgggtataggcgaaccgctggtcgccgtgcaccacccggctgtagtcgatgccgagcgccgggtcgttgatcacctggcggctggccgccatggtgatggtgaccgggaaggtcggcggggccaccacgtccgggtggccgagagcgcgggcggcctcggggtcgtgatactccgcctcggtggcgccgatcgcgcgggcgaactcacggatcttctcccggccgacgagataggtgtccgtgggcggccaggtgcggccggcaaacgtctgatccaggggcataccccacaaactacaatgcgccgcccggagtgactccgggcggcgcatcggaaaacttctggggctgcggccccgctggatcagcgggtctcgcggtgcagggtgtgcttcccgtcgcgcgggcagaacttcttcagctcgacgcggtcggggtcgttacgccggttcttcttcgtgatgtagttccggtccttgcactccgtgcacgccagggtgatcttcggacggacgtcggtcgccttggccacggcggggtgccttcctgctaacggaatctaacttgtcgacaaaccagcgtagacgctcggcgggtcgctctgcaaagcgggccccgaaaccaccggaatcgaggcatggtgaacccctgaccggggatcaccagaaagtagcggtggccggacttgaaccggcgacacagcgattatgagccgcttgctctgccaactgagctacaccgctgcaacaggctcacgtccatcgccgggcggcgggaacgaacccggtagagcccccttacggaatcgaaccgtagaccttctccttaccatggagacgctctgccgactgagctaagggggcttgctgcttgcgatctctcgctcgctgcaggagtaagactacacggccccgacccgggggtgaaatcgaccccccaacccggcagaaccgcaggtcagatgactgcccggagccgacggacctcaccggtgggagtggactcgggctcggtctgcgcgctcagccacgcctccaaccgctcgaacggcagcggccggctgaacaggtagccctgaccgatctcgcagcccatctcctccagcagctccagggtgagctcgctctccaccccctcggccaccacggtgagaccgaactcccgggccaggctgacgatcgcccgaacgatcgccagatcacccgagtcggtcgccatgccctgcacgaacgtgtcgtcgatcttgacctcgtgcaccggccactgccgcagatagcccagcgacgaggcgccggtgccgaagtcgtcgacactcagccggacacccaggtcccgcaggcggtagagggtgggcaggacccgctcgatgtcactgagcatgcccggctcggagatctcgaaggtaacctggcccgggtcgacctggtgcacgcccagcagatcctggaccaggtccgggaatcgggaatcgagcagcgtgcgggccgacaggttgaccgcgacggacagcggccggtcggcgtccgcccaggcccggcagtgccgcaggccggcggtgagcaccacctcggtgagccgggccagctggccggtgtgctcggcgaccgcgacgaagtcctccggggccacctcgccgtgcgccggatgcacccagcgggccaggcactcgacgcccagcacgtgtcggtcggtgagcgtcaccttgggctggaagtagacctccagctgatcgctgtcgatcgcgcggcgcagatcggcggcgatgcccagccggcgcaccgcccgggactccagcgccggatggaacggctggacgccgtacggcagcaccttcgccgcgttggcggccagctccgcgcgctgcagcagtgtctccggatcggcgccgtggtcggggtgcaccgagacaccgaccgcggtgtccacatccagggtcagcgagccgaccgccatcgggccgcgcagccgctcgcgcatctgggtggccagctcgatcgtcgcgtcgatgccctgggcccgcagcgtgaccatgaactcgtcgccgccgacccgcccgaccagggcgcccgggccggcgatcccgcgcagccgctcggccacctcggcgagcagcttgtcaccggccgcgtgacccatcgactcgttgacgttgcgctggccgtcgacgtcgaacagcaggaccgcgacgacctcgccctcgaccgccacccgcaccgactcggcgagggcgtcgagcatccgccggcggttcggcatcgcggtcagccggtcgtggtacgcgtcgtagcgcagccggtcgaccagccgcgaattctccaccgcgaccgcggcgtgcgcggcgatcgtctccagcacctgcacgtcgctgtcgcggaaggtccggccctcaccgatccggttgaccacctcgaccgtgccgatcaccgcctggccggaccggagcgggacgacgaccgcgtccttgacccgcactccgcgcagcgccccgcgaacccgcgcgtcctccgcgaactgccggccgaaggcgatcgggctccgccgctccaccacgaggtcacgaacggcggacgggaggggcgacatgtccaggagcccggcgttgtcgacctgggcggagagcagcatctcgggatagcgctcccggggagccagccagagcgtggcgaactcggcattcatcagcgtgcggacccggccgagcaggacgtccggcagaccgtgatcggagacctcgttgcggaccgcctgggtgatctcgtagacgtcggcgagcgtctggtgctgccggaagaacccggcgaacgagcggagcacgaagaccagagcgccgatcagcaccgccatcaggagcaccgaccagccggtcgcgtcgagcgcgttcaggaagagcaggccgacggtcgcgctgatgcagggcacgatgaagctggacagcatcgggcggaccacgttgcgcccggcctgtatcccctgcaccacgctcagcacaccgaacaggctggccaactgcaccaacagcatgagcacggtggcgaagaacaggatcgcccaggttttcggactcgtcgccaccagcggccggaacggctcgatcaccagcagcgcggcgcagatgctcgccgccgcccgggccaggttgtagaacgtcttgaccgggctgtaagggcccttgagcagcgtcaggagattgccgcagacgattgtcagaatcaccatcatcggcggcaggtagaacaggcccagaacgagggggacttcgttcaggtgcaggacgaaggaactgcgccgcacgaccacgttgaacgcggcgaacgaggcaaccgtccagagaacacaaatcaggaggccgaggggccacgcccgccaccagtcggtgtcggtgacccagaatccggtggtgcacacgacggcgaacaacgccatggggccggtgatcgcccaggaatactgctcagaacgctgctgcggacccgaaggccttggcatgagcgctccctatcgaatgggtcggcgtcctgagcagccgcggatctgccgccttatcagttccagctgtagtcgagcgtggagaactgcaccgcagaggaatcggaggccacgtgcccgaccgcactggtagccacgcccccgaccagcgcgacaagcacgagagccatgctcgcgtagcggatcatcttcttggcagacatccctatgctccttgtctgggagtgcacttaccggggtcccatgatggtgccacaccggctgtgcgacagggagtgttcatcggcgggtcgccacgacgctccggcgaatcctggccgaaaggctgaggtggggacgagtgtccacgctgaagtattggcgtctttatagaccatttaagcggagaagtgagaacaattcgccctgcagcgtcaggtaggcttgacgtcaagcagtcttgacgaaggagtgcccaccgtgatgactcccgacgatcttgagcgacaccatacgctcaccacggctacccggcgttacgacgacctacggatgcgggacgccctcgctgcgatgggccgcgacgacgacaaccccggcctcacccccgccgaaaccctcgaaatgctggccctcagcgagatcatcagccgcaaggccggatacggccggcaggccatggtccgctccgcccgcgcggccggcgtctcctggacccggatcggcgccgccctcggcaccagcaaacaggccgcctgggaggcccaccagcgctggatcgacgaccaggcccggcagcacgaacaaaccggataccagggcctggacccggaatcggcgcacgacgctcgcggcctcgccggccggcccgactagtcgccgatggcagccgggcggtccgtcgcgctgtactgcgaccacgaacccgggtagagccggccccgccccaggcccgcatgctccatcgccagcaggttgtggcaggcggtcaccccggaaccgcaatacgagatgacctcggaggcatccgacacccccaccgcggcgaaccgctcccgcaactcggggaccggtaggaaccggccgtccgcggacacgttgtcgcggcacggcagactgcgggcgcccgggatgtgaccggcccgggggtcgaccggctcgctgtcgccgcggaaccgggcggcatcccgggcatccagcacgaggtggccaccgtcggcggtgtcggcgagcgtggccaggcgatcctcgggccacggacgcgcggagaagaccgcggcgcggcggggggcgggctcggcggtcagctccgcggcgtacgccggcaatccgccatcgagaagagcggcctcacacccgagcgcgcgcagcaaccagacgagacgagcggcgatgacgccgccggcgtcgtcgtaggcgacgacggtgtccgcgtcaccgatcccggcggcggacatggcggccgcgaagaccgccggatccggcagcggatgccggccctcggccggcgacgccggagcggccagcgcggtgtccagatcgatgaagacggcgccgggaagatgaccccgctcgtacgccgcgcggccggagcggccgtccagataccaccggacgtcggcgacgatcacctcggcggcgtgggcacgcagccagtcctgatccacaaccgcgtcgatcatgtgcctctttccagtctcccggcaggcccggattcagtttcccggcaggcccggattcagtctcccgacaggcccagacgaagcccgaagccgatcagaaccgcgccggtcccggcatcgacggtacgccgtaccgtgcggcgcgccaggaagccgcgcgccgcccgcgcgccgaagatgagcaaggtgaaccagagcagcccctccaggtcatggaccagggccagcagcaggccggcaccgagcggcggcgacccggccgggatgaactgcggaagaaccgcgacgtagaacgcgccgaacttcggattcaacaggttcgtgagcagaccccgcccgaacgtgttccaccaggtcgcggccgaggccacggcgacctccccggtcaccgccggcttccgcagagccgagacgatcatgcgtacgccgaggtagagcatgtagcccgcgccgaccacccggagcacggtgtacgccaccgccgacgccgtgagcagcgcggagactccgaccgcggcagccgcaccccagaccagcgcgccggcgttgataccgagcgcggtggcgaacgccggaccccggcccatggtgaccgcggaccgcaccaccagcgcggtgtccagaccgggagtgatcgtgagcagcgcgccgagaagggcgaagctgagaacggcgtgagtcatgatcccttcctaagccttacgggtcggcccccgcccccgaggtcggaagcggacgaccgcgacccccaccagaaccaccgcgagcagccccgccgcctgcgccgccaccgttccgggcagatgcagaccgcccacgtagatcaggagagccaggccgaacagcaggtggtagtaaccggcgtcccggaccgaccggaacgaccggacgatcatgcccggtgcctgaccccacaccagcatgcgcatcccgaagatgaacagcgcgaggcccgccaggccgcccagcacctcggtactcatcgccccagtgtgcgaccgggccgggcggcgaaccgacggttagcggtaattcgtgaactgcagcgcgacgccgaaatcctccgccttcaacagggcgatcacggcctgcagatcgtcccgcttctttccggtgacccgcagcgagtcaccctggatctgcgcctgcacacccttcggcccctcatcgcggatcttcttgctgatcgccttcgccttgtccgactcgatcccctccagcaccttgaggtcgatcttgaaggtcttgccggactgccggggctcccccgcatccagcgacttcagcgaaatgttccgcttcaccagcttctccttgaacacgtcgagcgcggccgtcgcccgctcctcggtctccgacgtgatggtgaaggcctcgcccgacttggcgagctcggtgccggtcccccggaagtcgaaccgggtgctcagctccttctccgcctggtggtaagcgttgtcgacctcctgccggtcgaccttgctgacgatgtcgaacgacgggttggctgccatgatcagactcctgcggctggatgcttgtcgatgatgcttgcgggcccgctccggccccgcgacatgccgaccgtacccggttgcggaccggccccgcggtacggctatgctcttgttcgctgccgcgcgaaggtgtggtggttgcccaggcgggttgcccgagcggccaatgggagcggactgtaaatccgtcgcgaaagctacagaggttcgaatcctctacccgccaccacagggtaaaagaagcccctcacctgctgaaacagcggtgaggggcttctctcgttggtcccactgggtctcactcgggatggctcgatctcactggtcgtgtcgtatacgtgtcggcgatcaagcggggggcgcgcgtcgtgggtcgcgccgtcgccttccctgccgaggggcttgctccgggccagccatgcgcacgctcgtagagggactgaaacagtggggtacgggaggagactgggcaggcttgggccgcgagcgcggcggcccggcgatgagcaccaaccacgctgcgcaccgggaagggtgtccggcgtcagccgggcctatttggtcgttcagggttgaccgtcacgccgctggcgtcgatccccgcgttttccctgctgacagttcggatgatggcgcttcaatgacaccatcgtccagcgtcatttttcgttccgggcagcctcagcacggaactccgctgcgatgctttcaacactcggtacgggaacgtccactacacgcgccaggtcaaccagcttggaccgatacttgatcgccatggtttcggcatccacagtaccttgaagcacgttctgcatcgaccgtagaaggtcaacgtatgccgacttacttctctcaatagccaggtatgcgccaaagtcacggtctgaccatcctgtcggcatgacacgctctttccaggccgagatgaacgcctctttctgccactccggataactcatcttgtgaatgtggacagccaggtcatacagcggatctccaaccagcgccagttcccagtcaagcacatataggccgccgccgggagcgcccgtacgcaggttcttcctgtgcaggtcgcaatgcatgagcacgtctggccttgcaacctcgcgctgcggtatagcactcacaattccgtctacagacgggagacttagtgcagcggccagtatcggccgccgctcaatagcctcatttgcgagtagaccgaggtgactgaccagcatgtcgagggtcgaggttactggcaggccaagtgcgctgatcgaatccctctgcatcgccacgaacgcggagaccggaacggtagtaagtgccgccatcgtgccgataatcgaatccatctgctgcatcatgaccgcagtaccgcgcgggcttatttcgttcagcgtcgcctctcccacgaatgagcagacgaagaacctgcgcgcaggatcggtacgccatacttgcggggcgtatacacgtcccgcaattgcttcaaggatagccacctcatccaacggtcgcagatccatttgatccgtcgcgggaatgcggctgcggacgattgcaacgcctgcatccgtctgagctacggcattgacgttgtaaaagccccgaaattcgggaccagtcacagtccatctctcgatcacggcagccataacctcagaatacacctcacagtctacgcaaaccatacctaaacccgcatatagtgcattgactcgtcactctgcgcaactaaatctggatcgttgcgcggtagcggtcgcgggcctctcctccgcatacgggagcggtgatgccgaaagcttgagccatagggaaatgacgcaacccgcgaccaggcaacgacgtcgctggcctagacggtcgcgccacaagtcgcgtcgccgcgaccggtcgcgcgtgttccgcgaccggaaggcggtcgttgggccggtcgtgccagtgacgcttcgtgttcgccggggacgggcggtcgctggccgggggacaccctgcccccgtcgttctcgctgatcggcgggtttgggggaacccggggcacgcgggggacagcggggacacggggacagcggcccgcgtgccggccgaccggtggcggggtggagctggcgcatgcggtgacaaccggggttgcgggcgggtccggccgggtagcggcacggcctgtcggtgcccgagagccgctgtccgggcgtttgcaagtggtcggcgagggtgccgctacccgctacctcccaccgttcgtactggccggacagcgatcgtgaggtagcgggcgaggtagcgcaaccgctacctacccgtgcgccgctacctccaccgctacccggtgcgccgggggacagcgggggacagcgtgtcccagacgtttccgctggtcagctcggtccggggacaccggggacaggagggacacggggacacctgtccccgccgacacacatccccgtcccccgtgtccccctgctgtcccccgtgtcccccaaccactcctgagctgggaaaaggagggggacagtacggggacagcagggggacagcgctggaggcggtacgcgagcacgccctgcgcgcatggccgtcaagctggtacgcgccgcgacaacttcggttgccgcccaccgctacccggtgcgccggggacagcaggggacagcgtgtccccgacgtttccgctggtcagctcggtccggggacaccggggacaggagggacacggggacacctgtccccgccaacacacatccccgtcccccgtgtccccgctgtcccccgtgtcccccaaccactcctgagctgggaaaagcacggggacagtacggggacagcgctggagaggtacgcgagcaccagtcaaaggcggactgaaacagaggggcaacgctcagggccataggcaagcctcgcttggttcacccctccccgctaggccctagcggggtcggccgctaggcctagcgggtccgctagctcaaccctcgtgcgcctggccagcgatctagcgcctagcggcaatcggacagcgcacccccgaaccgcccgcaggcacatccatatgaccccacccagccagccgctaggagccccgctaagccaagatctcgccctgcttgggagaccaacccacccaacgccagatagacggcgagtgcccttcccccgcctccctgtttcagcggtccttgatcgttggacccgcttgcaggggccctcgttgtcgcatccgtgtcggcctggcgccgatcggggttgtttcgcctggtcagcgacggatgatcagcagactgtaaatccgtcgcgaaagctacagaggttcgaatcctctacccgccacaagcacagataacggccctgagaccagcggaaacgcggtccggggccgttctcgttgtgctctagcgagtcccgcaaaatccggccgtctacgaccctccacggcaacatagcgggaacacttcccccattcgtccccggtagggtgagccttcacctagcccgccggaacctcgtcaacctcatcctgcgtgccggtagaagcaacacgactgaggaagtcagtaagcaggtgagcgcgcaggcatgcatcggattctgcgggcgccttggttcatccgggcggcatggccaacgccccggatctccttctacctactcacgccagcgtgccgctttccagggacgccgcgccgactgacgtgccgtaccgtggacggaagcacccttcttatgagccgctgctggaggtgacgtcgtcgatgagcgtgggagtggttgaccacgtcggtccatggactgaggacgagtattttgcgctcggcgagacgacggaccggatcgagctcatcgatgggagcctggtggtgagccccgcgccgagcatgagccatcagcgtctctctcgccgactggcgaacgcgctggacgagggcgccgaaccagccgggctctttgtctatgaggcgatcaacgtccggctgaacaccggccgaatcgtcattcccgacctggctgtggtggaccaggacgaggaggccgtcacggcagacgcttcccgggtgctcctgatcggtgagatcgtttcgccgagcaatgccgccatggaccgtgtactcaagatgcagctctacgccgctgcgggcatcgggtggtacctcctcgtcgagcacgaggcgccggactcgctgacgctacggctcaaccgtctcgatggccagcactacgtcgaggaaaccgtcgtgaagactggcgcgagcttaacctccgagtacccgttccggttcgacctcgacacgcgttcgctcgttcgtcgctgacagccgcagccgccgacagcgccggccaccacaggataaaagaagcccctcaatcaactgctgagacagcggcgaggggcttctcccgtcggtcccaccgggtcccactcaggaccaaaggcgaccagttcgggcgtgcggtgatggactgcggcgagcagcgcgccaacttgtgccgggttgaccactgccctgcggtcgacctcatcgtcatgctcggggcactccagctcaccccgagccctgttcacaccaggatcttgtcggctgaccgacaaggtcgttccgaaccggcgggagatagatagacgttcatacggtggtggcactttgcgcgggaaatctgactcgctacggccttacgccgccgacctgaccgacgagtccgaggccgcccgggagacccggagctacgccgacaagtgggggacgttgcggcgggcggggacgtgccggggctatttgatgcggcgggtgttgcgggcgaccagcggttcgaactccttgtgctggtcgagccatgcggcgatgaaggggcacatcgggacgacggtgcgcgacctggcgcgggcgtcttccagggcggtccgggccagggcggagccgacgccctggtgttcgaaggccgggtccacctcggtgtgggtgaagaccacgatggggccggtcatctggtaggtgaggaccccggccagggcgcccgtgtcggtgcgggcttcgaagcggcccttgtccgggacctcggcgacggtgaactccatgccgccatcaaaccatgatgatcaggtgaggcggtcggtcacctcggccagcatggcgggcgggagttccggggcctccaggaggcggggcaggcgggtggggtcgtgcatgtagatctcgtaggcctcggtgagggtcaggccgtgcgacgggcggtcggtgaccgtgatgcggtcgccggggaccagtgtgccgggggtgagcacgcgcaggtaggcgccggtgcggttggcctgggagaagcgtttcacccagcggggctcggccatcctgttctggaaggtgaggcacgggatccggccgaacgtgacctgcaggagcaggccggaaccgaactgccattgttcgccgatgacgccgtcgcgcaggtcgaggccggaggtggtcaggttctccccgaaggtggccggagccaggtcgcggcccaggttggcggcccaccaggcgtaatcctccgtggcgtacgcgtacaccgcctggtcgtcgccgccgtggtgccgggtgtcgccgatgtggtcgccgacgatgccgctgtgcaggccggtgcggcgcgggccgggggcacggacctggaccggggcggacaccggcttcttgttgatgccggtggtcgggacgtccttgcccatgctcggctccgaagcacccacgttgaccgacaacgcgatcccgttcacgcgaaagtcaccaccgctcgatcctccaccggacggtagccgagccggtggtaaagggcattgctggtcgggttgtccagatcggtgtagagcacgacctcggccgcaccctcgtcgagggcggcacgggtggccgccgcggtggcgccggccgcataaccgtggcggcgcagggcgggtggggtccacacgtacaagatccggatcatgccggccgcgggccgggagcggaccgccatcgagaccggggtggcgtcgtcgacccggagggtgacccggggcagcagttcgtcgacgaccgcggcgacgtcggcgcggggctcgccggtgaccgcgaagaagtcggtgagccaggcggtcaccagatcccggtcggccgggccggcgggccgcgcggcacccggcggcgacggcggggtcagcgtgcccagggggtgcaggcgggtccgcatcccgggctggtgcgcccgggagccgacgaacgcggggagatcgtcgacgagcatgttgaccccgggaagcgggcggctccgcaaggccgcggcggcggccggcacggcgggcgcgggcagcgcggtgaacatcaccggatgcgggggcgtctgcagcaggacaccgctcaccgagtcgtcgccgggggtgatccaccagccgaaaaccgggtctcccgcgccgtaggcgtgcaggccgcgggaacgcaggttgtcgatcagggtcaggaaaaccgtgtgccgcaccggtgaggcccgcaggaaatccccggcgaccgcggcgaatcggtccagatcggacctgatctcccaggtcatccggtcatcctagatccggtcatcggccccacgccttcgctattcgggcgagggtgtcccgccgggtctccgggtcgtagacggtgccggccagcatcagctcgtccgcgccggtgcgggcgaccagggcatccaggccggcgaccacctcgtccgcggtgccggcgtactgcgtgccgggcaacgcgtgcagcatctgacgatccagatcggacaactcgcgggtcgcggcctgctcgggcgagatgatcgggccgagccgcccggtgcgcaggctcaacgccatgatccggctcgggccggcgaggaactccgcctcctcggtggtctcggcggcgatcaccgacgcgctgaccatcacgtgcggctcgggcaggcccggcgacggctggaagcccgaccggtacagctgcagcgcggcgtccacatcggcggcgatcgcgaagtggtacgcgtagcagaacggcaggcccagagcggccgcgacctgcgcgccataggtcgacgagccgaggatccagacctgggggtacgtctcgggggccggcgtcgcgtgcagacgccccgccgcgcccgccacccgagcgtcaccgagcagtcccagcaccgtccgcagatgctcggggaaccgctccacggtcagatgcggcgacaccccgcgcagcgcggccgcggtcgcctgatcggtgcccggcgcccgcccgatgcccaggtcgacccggcccgggtagagcgcctccagcagcgcgaactgctcggcgaccacgaacggcatgtggttgggcagcatcaccccgccggaaccgacccggatccggccggtctgcgcggcgaccgccccgatcagcaccggcggtgaggtcgacgccaccgccggcatgttgtggtgctcggcgacccagaaccgggcatatcccagctcgtcggccgccctcgcggtcgcgatggtgccgcgcaacgcgtcggcgctgccgtgcccctcgcggacggtggccagatccagcacggagagcggaacacgggtcatgacctcatccaatccggaaaaccgggtgggtgccacggtgatgccggtctcccgccctaggggcggcgctgctggtgccggagcacctggacgccggcggtgaccgcggccagggcggccccgggcaccagcatccagaccggccacgggtagatctcgtggtcgaccgtggtccggaccagtgcgtacaccaccaggttgacggcggcgagcgccgcccagacggtccagagcacgatcagcgcgaccggcagccgccgcgactcccgccggctctcggcagcctggcgggcccgcacctcggcggcgctcgtcccgggctgcggaagatcacgaaccaggaccaggagttccgcgtacgtctgtgccgcatacgccgcggccacccggtcgtcgtactcgtgcagcgacagccggccctcgtcgagcgcgcccttcaactggtcggcgatcagctgccggtcggagtcggcggcccgcagcgactcgatctgctcgccacgccgccccgggccggttacctcttttgccatggccgggctccttcgcgtacgcgccggttgtcggcgtcaggctatcgaaaaccggcgacgctgtggtgaccgtgacacggcgcgctccgcggaagccacccgggtcagtgtgatcggaaacgggcgccggctgaccgcgtacgccggcaatcggatcggtccggggagaagcggacggccgcgcccccgcgcggccgtggcctcagcgaaggtaggggcgggacgccccgccggtgagcgacgcctgctcatgcagccgacggatccgctcgaccatcggcgggtgcgtggcgaagagcgccgcgatcccctcggcgcggaacgggttggcgatcatcaggtgcgccgcgctggtcagttgcccctcggccggcagcggcatccgctgcgtgccgtagtggatcttttccagagcactggccagggccagcggatcaccggtcagggtggccccggacgcatccgcctggaactcccggttccggctgatcgccagctggatgatcgacgcggccagcgggccgagaatgagcatcagcaacagcgacgccgggttcggcgcatcgtcgtcgtccgaaccgccgaacggcaggaagatcgccagctgggcgagcatggtgacgatcccggcgagtgcgccggcgacgctggagatcaggatgtcgcggttgtagacgtgcgacaactcgtgcccgatcaccccgcgcagctcacgggcatccaggatccgggtgatgccggcggtcaccgcgaccgccgcgtgctgcggatcccggccggtggcgaaggcgttcggctgcatcgacggcgacacgtacagccgcggcatcggctggccggcctgcgccgccagctcccgcacgatctggtgcagcgccgggaactcggcctcgctgaccggctgcgcgcccatcgcccgcagcgcgatccggtccgagaagaagtagctgaccgcgttggtgaccagcgagaagatcaccgcgatgacgaggccggtgctgccgccgagccaataccccacggccaggatcaggccggtgagcaggccgagcagggcggccgtcttgagtccgttgtgatggctgtgcacgttcgactccttcggcatgcgggctcgtgacccacactccagagaacgcggaaagcctgcacgttcatccgggcggacgctgtgagtacgctggaacgccgcgagcgtcaacccgggagtcgccgccgccggggcacgctggcgggcggcgcgatgggaagccgcgcggcggggcgcggcgcgatgggaagccgcgcggcggggcgcgctagctagctagggcgcggcgcgatgggaagccccgcggcgcggcgcggcgcgatgggaagccccgcggcgcggcgcggcgcgatgggaagctccgcggcgcgatgcagaaccgcgcgatgccgtgccgggcagcccggtgcggagccgccgccaagcggcggatgccgtgcggagcggtgatcccgagacgtgcggccgcggcgagggctcagctcagcgcggcgaagaggagctgcggggcgaagcccagcacgatggccaccgccaccgagaccgcgagggtggcggcgaccggccgggaaaccggaagccgggggtgcagggcggcgtccatcagggccgggtcggcgacggtcatgccgatccgtggcggcagggagtagagggtcgcggtgacccggatgtagtaggccagggcgatgaccgcgttcaggaccacgaccgcggcgagccaggaccagtggtgccggatcaggacgtcgaccacggacagcttggcgaacagaccggccaggcccgggggcagcccggccagaccggccagggacagggtcagggcggcgcccggccacgggttgcggcgggcggctccgcggtggtcgaggatggtgccgccgtcggcgccgggcaggcgcagggcggtcaccacggtgaaggcgatgaactccaggaccatgaacaggaccgcgtaggccagggcggcgggaacgcccggagcgccgagggccagggcggccaggatgtaaccggcctgcgcgatcgacgaccaggccagcaggcggaccatccgggtctgccgaagggcgaccaggttgccgatggtcatggtgaggacggccagtaccgccatgaccgcgcgggcgtcgagacgggcgacgatcgcggccagcgccaggacgccgcccagcttcgaggcggtggacaggtaggccgcgacggggagcggggcgccgtcgtaggtggccggagcccaggcgtgcagcgggacggcggcgaccttgaaggccaggccgatcaccagcagggccacgccgacgccggcgagcgggcggaacgggccggtggccgggtgcagcagggccaggtgcaccgagccggtggcggcgtagttcagggcggcgccgagcagggtgacggccgtggagacgacgctgatcaggaagaacgtcagcgaggccgagacgccggcggtggtggggcgctcaccgggggcgaagcggcgcaggccgaccaggacgtacagcgggagggtcagcgtctccaggccgacgatcagggtgatcaggtcgccggcgtaggcgatcaccacgccgccggtcatcgagcaggccagcaggaagcagaactcgccggccggggcgatgccgaggcgcagggccggggtggacagggccaggacgccgacggtgagggcggcgaacagggcggcggtgaccgcggccggccaggtgggcagccaggagcaggcgccggtggtgcagaaggtacccggttcggggccgacgaccagggccagaaccgcggtggccaggccaccgagcgcggtggcggacaggacggcggtgcggttcgccaggaacaggtcggccaggaaggcgaggatcgcggtgccggccgccgcatagaggggcagcagcgcgaagtggtcgacggactggctcacgagcgccctcccatcgaggtcggcgacggaccggccacggggtggccacccggccgggtcggagcaggaccggccacggggtggacacccggccgggtcggagcagaagcggccacggggtggcctcccagcggggtcggagcaggaccggtcacgggtgtcctcccagcagggtggtcagcgggacggcggttttggcgatgaccagggccgggatgacgccgaccgccagggtgagcaggatcagcggggtccaggcgaaccattcgacgccggcgatcgagggacgcagggcgtggacggtcggggtggtcgggccgtgcgtgacccggcgcagcaggcgcaggaagtacgccgcggtgagggcgccgccgagcgccgcgacggcggccagggtgagccagagtgggccgccccggcggaccgcggcgagcaccgcgaacgcctcgccccagaagccggccaggccgggcagcccgagggaggcgatggcggcgaagccgagcaggccggccagccgcggcgcggtctcccgcaggccgctcagctggtcgagtgagccggtgccggcgcggtccttgatcgtgccggccaggaagaacagcaggccggtgatcaggccgtgtgccacgttgccgagcagcgcggcctgcaggccggtgaccgtcagggtggcgatgccgagcagcacgaaacccatgtggccgacgctggagtaggcgatcaggcgtttcaggtcgcgttgccgcaggcagatcagcgagccggcgaggatcgcgatcacggcgagcacgccgaggaccggggccgcccaggaggcgccctgcggggcgacgccgacgccgacccggatcaggccgtaggtgcccattttcagcagcacgccggccaggacgaccgagccgaccgtgggcgcctcggtgtgcgcgtcgggcagccaggtgtgcagcggccagagcggggccttgatcgcgaatgcgaccgcgagcagggcgaacaccacgcactgggtggtgcgggagagcatcggggcgccggtcaggctgatcaggtcgccggtgcccaccctggtggtcaccagcagcacgccgagcagcagcaggaccgagccggccagggtgtagaggacgaacttgcgggccgcggcacggcgttccgggccgccccagccggcgatcaccgcgtacatcggaaggaggacgacctcgaagaagacgaagaacaacagcaggtccagggcgaggaaggtgcccaggacaccgacttccaggatcaacaacagggcactgagcgtacgaccggagccgccgcccctgggcaccttgcgcaccgtgtacgcgcagcagagcagggtgagcagcccggtcagcacgatcagtggataggagacgccgtccaccccgaggtggaaacgcaggccgagggccggcacccagggcaggtcgagattgacccagggcatcaggggcacggtgtcccggccggtgaagccgacccagacctggccccgctgcccggcgaagaccgggacgatcgagagcccgaaggtgatcccggcgaagacggtggccacgatccgggcccgccggtcgtgccgggccgggagcacagccaccacggccgcgcccacggccgggaccacgagcagggccagcagcaggacggaccccgctgtccaggtggcggtgtcataggcatagtcgtggaacatcagcccagggcccccaaccacgcgacgacgctcaggatcagggcgccgaacagaaccaggaccgcggcgccgggcaggctggcccggtgcgcgtcggcgaacatcccgccgagcccgcgggtggccgtgccggcgccctcgacggcggcgtccaccacccgctcgtccgcagcggtggcgaaccgggccagggctttggccggtcgtacgaccaggaggctctggacgtgatccagatggaatccggcggcgaacagcggccgggcccggcccagcgcctcggccgggtcggccccgggtaccgcccaccacaaccaccaggccgtgccggcaccggtcgcgagcaacagcatcggcagcaggatggcgacgctcaggtgcgggtcgtcgagctccagcgcgtgccggaagccgggggcgaaggcggccaggccgagcagcgcggccgggatcgcgagcagcaggatcggccagcgcatcgggccgggcggatcgtgcgggacggccggggactgatagcgcgcgtcgtcgaagccgacctcccagtgcgggcccgccggaccgtgcgcccgggacgggccgaagaatgcgcgcagcagcaggcgcgtcgcataccaggcggtgagccccacaccgagcagcgcggcgacccagaccagccaggcggcccagaccggtgccgtcccgccgccgtcggtggcgtgcgcggccgcggtcagcacgttctccttcgaccagaagccggcaagcgggggcaggccggccagcgcgctgaggccgatcacgaacgaccagaaggtgaccggcatgtgcgtgcgcaggccgcccatccgggacaggtggttgccgcccacggtgtggatcaccgcgcccgccgcgaggaacagcagggctttgaaggcggcgtgggtgagcaggtggaacagggcggccgcgggtgaaccgacggccagcgcgccggtcatgtagccgatctgcgagaccgtggaccaggccagcacgcgtttcatatcgtcctgggccatcgcggacagggcgccgagcaggatggtgatcgacgacatcaccgcgagggtggccagcgcggccggcgactgctggaacagcgggaacgtccggaacaccacgtagaccccggcggcgaccatggtggccgcgtggatcagcgcggagatcggggtggggccggccatcgcgtcgggcagccaggtgtgcagcgggaactgggcgctcttgccggccaccccggcgagcagcagaagcagcgcggcgatcagcgtgccgtggccgtaggagtgggtgagcaccaccgacagccgggatgtgccggcgccggcgaccagcagcgcgatgccgagcaggaagccgacgtcacccacccgggtgaccaggaacgccttcaccgcggcggccggggcctcgggtagccggcggtcgtggccgatcagcaggtaggagcaggcgcccatcacctcccagccgatcagcaggccgatcaggtcgccggagctgaccaccagcagcatcgcgccggtgaacagggcgacctgggcggcatagggcgcatagcgcgggtcgtcgtgcagataggtggtcgagtagacctggacgcacagggcgaccacgcagaccgcgagcgcgacgtagagcgcggccgggccgaccgcgaagccgagcgtcacttcgatgtcgccgaagcgcgcccaggtggtgccggccgccagcggcgcagcgcggctggtggtgatcgccaacagggcgatcgcgtcgagcagggccagggcggcgccggcgatgccgagcgtggcggcgagccggcggggcccaccgtcgcccgggcgcagggtcaggccgagcaggcccagcagcagggggatgccggggagcagcgcgccgagaacgtcggtggtcactgatccacctcgtcgagggcgacctcgtcgatcgcgacggcccggcgcatccggtaatactgcaggacgatggcgaggccgacgcccacctcggcggcggccagcacgatcacgaacagggcgaagacgccgcccgagccgggctgcgcattcggcgtggcccaggactcgctcgggacgccgcgcaaggtggggcgcagcgacacgtcggcggtgaccaggatcaggttcaccgcgttcagcatcagctcgacggccatcaggaccaggatcgcgttgcgccggcggaccacgccgtaggcgcccaggccgaacagccacgcaccgatcacgtagggaacggtcacgtgcatcaggccggcacctcctcgtcctcgtccgtctgcctgtccgtcgtctcccccggtgcggaagggtgccccgtgcgcctgccgatatccgggcgggacagcacgatcgctccgaccagggcggacagcagcagaatcgagagcacctcgaacgggagcacccacgtgccgaagacctgggcgccgatccgctcagcggtgccgggggcggcccgcggatattcgatccagcggaaggcgtcggcgaacagggcggccaggccgagaccgacaccggcgccgatcagggcggaggggccggcgggccggtccaggtcggggctcgggccgatcggggcgcgggtcagcatcaccgcgaacagcagcagcacgaccaccgcgccgacatagaccagcacctgggtccaggcgaccagttcggcgccgaggaccaggtagaggccggcgatcgcgcccagcgagacgaccaggtagaggccggagcggaccaggtgggcgctggtcaccaccagggcgcccgagccgaccgccacggcgcccagcgcgagcatcaacacatcggcgacggtcactgctggctctccgggcgctgctgcgggcgtaccgtagccggtcttgcggtcttggcggcggtggccgcgcccggaccggcggccttgcgtgccgcggtcgcctcctccttggaaggctcgcccagcacgtcgtgcgcaggcggcggcggcacggtccgcatccactcgcccagccggcccttgtcgtgcagcagcgagaggacgtcggtctccgcgtactcgaactcgggggtccagtgcagggcgtcgaacgggcagacctcgatgcagatcccgcagtacatgcagagagagaagtcgatgtcgaaacggtccagcacgttgcgctgccgggcgcgggcggcgcccggaacgacgacctcctccttgtgcgagtcgatgtagatgcaccagtcggggcactcgcgggcgcacagcatgcagaccgtgcagttctcctccaggagggcgatcacgccgcgcgagcgcgggggcagctccggctcgacgtccggatactgctgggtgatggtcttcctggtcagtgtcttgagggtgacggcaaggccattgatcaaacccttgccgggtacgaggtggtcgccgtcatcagtcacaagggcatatcctgcccgcttcgtccgagcgacgcgacctcgacccggcttcgaacgccctcccgtgcccgaccatcgccgcgaccgatcgcacaccggcgctcagagcagggacttcaccgcgacggtgaggaccagctgggccagcgagaccgggaccaggatcagccagcagagtcgctgcagctggtcctcgcgcagccgggggtaggtgacccggaaccagatgatcacgaaggacagcgcggccatcttgagcagcgtccacagccagcccaggtgatccgcgaacgggccgtgccagccgcccaggaacaggaccgtggtgagcgcggcgatcacgatgatccccacgtactcggcgagcaggaagaacgcgaaccgcaggccggtgtactcggtcatgtagccgaagaccagctcggaatcggcgatcggcatgtcgaacggcgggcggcggatctccgccagcccggcgatgaagaagaccagcgcggccggcgcctgccagatcagccaccacgggcgccacgcctcgacgatgccgggcaggctcagcgtgccggccgccatcgcgacgctggccgcggcgagcaccagcggcagctcatagccgagcagctgggcggcgccgcgcaggccaccgagcaggctgtacttgttggccgaggcccacgccgacatcagcacggcgaccacgccgatcccgaggatcgccaggaccaggaacaggccgatgtccagccgttgcgcgaccaggccgtgcgggccgagcgggagggtcaggatgaccaccaggtacgggaagagggcgacgatcggcgccagccggaaaacggggcgatcggctccgtccggatgcacatcttccttctggacgaatttgaccccgtccgccacgagctgcgcccagccgtggaaggcgcccgcgtacatcgggccgacccggccctgcatgtgcgccatcaccttgtgctcggcctgcccgaccagcagcgggagcaccaggaagcccaccatcacggcggcgacccggatcagcagatccagccagagcggcatcagccggcctccccgcccctggtcctgcgggggccccactcgctcggatcggggacgcccggcgggcgcatcggggcccgcttcgccgtgccgtgctccgactcgcccggctccttggcccccggccacggcttggccacccgggcggccagcacgaactccttgcgcagcggatgcccctcgaactccggcggcagcagcagcggccgcagccccggatggcgggcgaagacgatgccgaacatctcgaacgtctcccgctcgtgccagtcggcgcccggatagaggtccaccagggactccacctccgggtcggcccgcggcacccgggtgcgcagcagcaggccgtgccgccgccgggtcgaccacaggtgcgcgaccacgtcgaagccgtcgtccagctcgtcgaccgcggacagccagtcgaagaagtcgcagcccagcgcacccggatcgcgggcgatcgtggcggcgtgccaccagcgggcgaccgggacgtcgaccaccgcccgggaatggccgggaccgccgccggacaccccggcggtgacgacgcccaggcccgggtcgtccgtctccatcaggtggacgaggcgttctccgacctcttcgggcgtcatggcagccatcctatgatccggggccggcctgcaacctcccgccgggcccggacgtgtagtcgccgtgacagcagttgacgagcatcgaacggagtggctgagcgccgtgccgcccgacccgccgtcgttcgatgaggtgtacgccgcgcactatgccgacctgaccgtccagttgtacgcctacttcggcgatcgccaggaggcacaggacgtcgtgcaggaggcgttctgccgggcgttcacccggtggcgcaaggtctccggctacggggatccggtcgggtggatccgccgcgtcgcctggaacctggcggtgagccgctggcgccgggtgcggacctccatcggcttcctgcgccggcagaccgtcgccgagctgcacaccgaaggtcccggaccggaccgggtggcgctgatctcggcactggccacgctgcccggcgctcatcggcgggcgctggtcctgcactacctggccgacatgccgatcaccgaggtggcccgccgcgaaggggtcgccgagggaaccgtcaagtcatggctgcatcgaggtcgcgcggcgatggccgcccggctgaatctgaccatcggaggcgagtgatggccgaccagatcgaacggctcttcgccgacctgcgtaccgacacgctgccgcggatcaggccgcccggcgctgacgcggcccgccggacggtccggcgccgacggcggcgggcggccgcggtgaccgggatcggcctggccgttctggcggtggccgccttcaccacccccctgcggctgtcctcgccggccgagccggccgccccactgagccaggcggaacgtgacagcctcgccctcgacgcggcccgggtgatccgcctgcacgattacccgcagaccaacggcgggacgatcaccggcgacggcccgctggtcactctcgacgtcctgcccggcgagtacgacttcgtcgccgcctgtgcgggccaggccggcaccgtcgacctgagggcaggcgagacgcacctggaactaccctgcggaccggccccggacaagaaggcgatcaccgtggcggtcaccgggcgacggcagcagatctccgtcgccgcccggtccgacccggccgcgctgggccgggtcgggatcggctgggcgctgaacctctccgagaagagccgggcgcagctgatggccgcggccaggcaggcgatcggggacaacgcgtcgagcaccttcctcgacgacaacggcgccagcggcgtgcaggacaacagcgtgcgagccggctcgtaccgggtcaccgcggcgtgcatcggcaccggaccggtccacgggcaggccgggaaccaacaggccaccggaccgttccacccgctcaaggccttcgtggtggagtgtgacgggaaagcgcacgacttcgatgtgaccatgccggccggcagcaagatgggtttcttcgaattcagcacggtcgcgtcggcccagggcgccctgggttaccgggtgacacgccgctgatctctcacaggcccgggatgcgaccgttgcggaacacgtcgacgaagtcctggtggtcctcccgggcctggtcaccgtacttgtgggcgaagtcgaccaggtgcgcgacgaaccccttctcgtccttgtcgaccaccgcgacgatcgcctcctcggtcgagaagtcgaccaggtcgtggctcgactcgtcgtcggcgaccgaatgcatccgggccaccgcccggcccaggtcggcgatcaccccggagagctcctccggctcgttgacatccgaccagtccagatccgcggcgtacggcgacacctcggcgaccagctggccgacgccgcccaattcggtgtagcccagccacgggtcggcgtgcgcctgcagcgcccgctgggactcggcggtccggtgaccctgatgcttgaagtaggaccggacccgctcgtcgtcgatccaccgcgccaccgccggcacctgggcctgcttcatgtagatgatgacgtcgttctccagggcctcggtgtgcccctccagcagcaggttgtacgacggcaacccggccgagccgatcccgacgcccttgcgcagcttgatgtccttgatgttggtggagatcggccggccggtgtccggcagcgtcgccagataccggtcgaaggcggccgtcacccgggccaccgtggcctcgtccacctcgaagacgccgtcgcccagggagaaccggcgctcgtagtcgtcgaccgtggtctgcccgtcgagcagggccacccgggtgttcagccgcgcctcctgcaacacccggcgcagcaccccgtccgcgttctccagggtgatcgacccgatcgcgtcgtcgccgccctgcgcgatcgcccgcagctcggtcaggtacgactcggcgaacgtggtgaccagcgccgagatgctgtcgtcggagagtgccttcgaatagccgatcagcgcgacgctcgccgagaagcgcttcagatcccaggagaacggaccgacgtacgcctcgtcgaagtcgttgacgttgaagacgagccgcccggacgagttcatgtaggtgccgaaattctccgcgtgcagatcgccgtggatccacacccggctggtccgctcgtcgagataactgtcgtcacggaagtcaccgacctggtcggcgtagaacagcgaggcactcccccggtagaacgcgaacggcgaagccgccatcttccggaacttgcggcggaacgccgtcggatcgatggccatcagctcgccgaactcgcgagccagcacgtcgacgatgaagtcggcacgagacgcagaactcatgccgcccacgctagaccggcggggccaccacgggagcggttagggcggcggcggtcctggtgagggggtcggggcgagagacgccgccggggccggactgctcggcggcgatcttctcctgcaggcgcaggatgccgtgcaacagggcttccgggcggggtgggcagccggggacgtagacgtcgaccgggatgatctggtcgacacctttggtgaccgcgtacgagtcccagtacgggccgccgcagttggagcacgaaccgaacgagatgacgtatttcggctcgggcatctggtcgtacagccgcttgatggcgggggccatcttgtcggtgaccgtgccggagacgaccatcaggtcggcctgacggggaccgtgcgcgaacgggatgacgccgaggcgcatgaagtcgtggcggctcatgctggaggcgatgaactcgatcgcgcaacaggcgagaccgaagttgaacacccagagggagtaccgacggccccagttcagcacgaaccggatgggttcaccgagcactccaggaagggccatttcgtcaacctactgcattctcgtacgggtcgatgaggctcatcgggcggcgcgcgtcctccagcacctgctgcgggaagttggagccctcgatgtagtagcgagcacgggtgcgaccgaccggttccagcattcccgccgcagccaggtcacggaggtcacgctgggcctgctgcagggtcagtccttccgcctgctcgtagcggtgccgccggattcgaccgaataccgctacgtcgtgcaaggcggagacgactcgctcgtccagacctttctgcccggcgaaggagaagagtcgttcccacaccgtcgccgacagatcggcttggccctgcaccatttgcgcctgctggtgataagccgtcaggttgcacctgatccacggcgagacgtcctggttcggccggtaggtagatccgcgggcctggagtacccggtagtactcgaacgtgttcagagactggccgagccatgcctcgatcgaggagaactccggagcaagcactccctcacgcgcgatcatcagcgtttgcagtgagcgggacatccggccgttgccgtccgcccacggatggatggaaaccagaatgagatgcgccattgccgcccggatcagcggatgcgcgccgtcgtcagtgtcgagccagtcgacgagttccgacatcagaccgggaacctcggatgcatccggtgccgtgtaggcgagggtgcgagtgcggtgtcctggagcagtgacatacacgggaccgtgacgccactggcccgcgggcttgttcggcgtatggcgatgcccctgcaacatccagtgcagcgcgttgagaagtcccttgctgtaggagaagtcggcgaagtcgtgcagcgtctgcacgtaggtcatcatccgctgataagcaagcgtctcctcgcgattctcgtcggacacctcaacgtcccgctcgccgtccatgaggtcttggacgtcagccgttgacacgcgaaacccctcgatggagttggaggctgcgaccgcgtccgcggtgagaaatttgcggagtccctgttcccacttggaaggccgcgactgaatctgatggcgaagtctttcgcgcatcacgtcgacctcggcgaggaccgcctggtcagcgggttcaagagcgggagtcgggtagagcacgattcaatcaaacaatgacgcagacattgcgtcaagaagacccgtcaggacgctggaggatgctgggaaacctagtcaggagggccagcgggttgacagcgcgtcccacgccttcggcgatagcacaagcaggccggctacgcccgcggcgacacccagcgtgtcggtcagatacggcggaagcaacaaaccgggcaccgtgccgaaagcgccggtgaccagggatccgaacgcgtacccagccaaaactctcctgggcggaacactcgcccgggttaccacgggagagggatcgcgggcgtcatcgacgcgcatcgtaaccatgatcgggcgttgccgcctacgctcgccagcatgggaagcgttgcggccggcgtcgccgcgagccatccggcgaccgcccgcaccggagtgcggattctcgaggcgggcgggagcgccgccgacgccgcggtcggcgcggttctggcctgctgcgtcgccgagacgatctacaccgggctgggtggtggcggcttcgccacctacttcgacgcgcataccggtcaggtcacctgcctggacttcttcgtcgcggtgccgggcctggacggcgaccggaagccggagccgatggtcgcggtcgacgtgttcttcggcgggctgccgcagatctattcgatcggtggggccagcgtcgcggtaccgggggtgccggccgggctgggcgaggtgcaccgccgctggggccggctgccgtggcgggacgtggtcgcgccggcggccgggctggcccgcaccggggtgctgctgcccgccgcgcacgcccgcacgctgcagtcgtgtgcgccggcgctggccttcggcgagggcgcggccccgtaccagccgggcggccggctgctgcagagcgacgagctgctcttccacgacgggctggcgaccgcgatggacgcgctggccagtgacgggccgggcgtcttctacggcggggagtacgccgatctgctggtcgccacggtccgtgcggccggcggcacgctgggcccgggcgacctgggcagttaccgggtggccgaggtggcggtcgaccatgccacgttggccggctaccgggtctgcgcccggcacgacctgaaccgcacggtggacacgatcggcgcgctgccggccgacctgtcccgtccgggccgggccgccgcggtcgccacggcgctgcgcaatctgggggcgcagcggctgggtgacaccaccaacgtctcggtggtcgacccggacggcaacgcctgcgtggtcaccacgacgctcgggctgggcgccggggtgtggctgcccgggctgggcatcaacctgaactccatgctgggcgagggtgagctgctcaccgagccactggtgccggggcagcggatgtcgtcctacatgtgcccgctggtggtgatcggcccggacgactcgctgaccgtcgcggccggttcggccggcgcctcgcgaatccgcaccgccctggtcgacacgctgctcggggtcctggtggacggcctggacgtggccgacgcgatcgcccggccgcggttccacgcggtgggcgacacgatccacgcggagaacggctgcccgccggccgagctggcgacgctgcgggaggccgggtggcacgtggtcgagtggcccgagctcaaccactacttcggcggggtgaccgcggtgggccaggccggggtcgccggtgacccgcgccggggcggggtcgggctgctgctctgactcacatccggcgggcggcggtcgcctcggccgcggccgcggtctcgcgcagcgccacgtccaggtcggtcggggtgaggccgaaggtgcgctgggtgcgcgagctgtccatgtggaacggcgcgtagaactggtagtccatctcggccagctctcgggcgatcggcaccaccaggccggccgtgcgcatcacgaaccgcggcaggcccttgaccttgacccggggcaccccggccgcgtcgcagtaccggtcggccagctcgcgcatgctgatcgccgggccggacgggacgtgccacggcttgccccaggcgcgctcgtcgcgggccagggtgaccagcgtgcgggccatgtcaccggtgtaggtgaaggtgtgcggcgcctccgggtcgcccggcgccatcgccgcccggcccttgttgatcgccggcagcagcaccgcggagatggtgctgacggcgccggccccgacgtagtccgaggcgcgcgcctcgaccgtgcggacgccgctggccagcgcgtcctgccacatcctggccctgatccggcccttgcgcccggtggcggccagcggagtgtcctcggtcatcacgccgccgggctgcgggccgtagccgtacagattcccggtgatcgcgtagaccgcgtcggcggcccgggcggcctcgatcatggcgtggttcatcggcggccacttgtccgcccactcggtgtatttcgggttggcgcagttgtagacgacctcggcgccgcgggccagctcggtcaaccgctgcgcgtcggcggcgtcaccggcgacccgctcgatcagcgcatgctccggcccgctgccgctgcgcgtcacgatccgcacccgctcgccccggtcggccaggaggcgggcgacgttcgcgccgatcggaccggaaccgatgatgacgtgcatgtcgttctcctttgtgagcaccgctctctgtcgagaacaacgatgacacatctcccgcaaccatgcaagagcactgctctcgttgtggcacactggctcccatgaaggccgccaacctgcgggcccgcgtccgggccgagatgaccgaagagatcaaacaggtggctcagcgtcacctggcaaccgatggcgccaacctgtcgttacgggccgtcgcccgggacctgggcatggcgtcgtccgcggtctaccgctacttcgccagccgcgacgaactgctcaccgcgatgatcatcgacgcctacgacgcggtgggggcggcggcggaacaggccgccgaaacgaccgacgacccgatgcgcaggtgggtggcgatcgggcacgcggtgcgggactgggcggtggcgaatccgcaccagtgggcgctgatctacggcagcccggtgccggggtatcaggcgccgcaggacaccgtcgtgccggccacccgggtgatcttcgcgctcgccgcgacgacacagatggcactggcgcaggggcggctcggggaggttccggcgcagccggaagggcgcttcggggaggagatggcggcggtcgcggcgcagatcaacccggatgcgccggcgcatctggtgggggcggtgatgtatggcttcgtgcatttgtgcggggcggtcagcgcggaactcttcgggcagctcaacaacaccatcgaagacgaccggaggggcttcttcgaatggcagatgcgagcggcgggaaggtttgcgggacttctttagaccacattcttttttgcgtgcgctgcggccgataactgaccgcagctcccgccgggacccttccgggccgggctggccgctgcgcgtccagaacgcccgacccgcaagggcgacatccgcgggtgggcgcggtcaaaccccgcgccgggcgtgcaggatgtggccaccggcagtgtcggcggggacgtcggtgcggccgaagaagcgggcggccaggccggacggccccaggtcctcgatgtcgccgaagccgtgcgcccccagcgtggcggcgatctcctccggctcgaagaaggtcagccacggctcgccgatcttggcgacccgggcggcgcgggcttccagggcggcgcggcgctcggccggcatccgctcgggggactgcgcatagtcgaagacgacctcgttgccctcgcgtccgccgacgaaccgcagcgtctcggtgaaaccgtcgacggtcaggtagggcaccacgcccatccacaggaagaacgcgggctgctccagcgtcagccgggcttccaggtcgtcccgctcgaagtcgatcccgacatatcggaggttgccgggaatgccgatcccggtcgaggcgagccgctcccgcttccacgcctgcgtgtccggatggtcgatctcgatcacctcgagcccgggatgcggattccggtaggcgaacgtgtccagccccgcccccagcaccaccgccgtccggatcccgcggcccaccgcggccgccagatgatcctcggcgaaccggtgccgcgccgcgatgaacagccgcatcccccgccggggcgcgtcacccagcagctcgtccggctgatgcccgaggatccgcagggccagcgggtcggcgaagatcgccccgtcctccagcacctggtgggccgcgcggtatcgggccgcggcgtacgccgtcctactcgcctgtccggtctccatcaggactccacccggctttctcgatcagcacccggtcgccgcgcaacggtacgccctcggcgagcagccgcgcccgcgcttcacgttcgtgcccgggcggcagccggccggcgctggtcaccacccggtgccacggcaccccgccgccgtgccgggacatgatcccgccgatctgccggggcgagttccgcccggagacctcggccagcgcgtcggcgaccgccccataggacatcacccggccctccggaatgctctcgacgagcgtgagaaccgcttcgacgtactcctggggtgtcatcaccggccacgatatgggatccggaccggatcgacaccgggcggccgagcagaatgggccgggtgcgggaagtggtgaccggtgcgcgccggatcgtggtcaaggtggggtcgtcctcgctgaccaccgcggcgggcggcatcgatgagcagcggctggattccctggtcgacgcgctgggccggttggccggcgcgggccgtgaggtggtgctggtctccagcggcgcgatcgccgccggcctggccccgctgcagctgccgcgccggccgcgtgacctggccacccagcaggccgccgccgcggtcggccaaggcctgttgatcgggcgctacaccgccggtttcgcccggcacggccggaccgtcgcgcaggtgctgctcaccgtcgacgacgtgacccgccgctcgcactaccgcaacgcctaccagacgctgcgcaaactgctggatctcggcgccctgccgatcgtcaacgagaacgacacggtggccaccgaggagatccgcttcggggacaacgaccggctggccgcgctggtcgccgccctggtcgacgccgacctgctggtgctgctctccgacgtggacgcgctctacaccggcagcccgtccgacccggcctcgcgccggatcccgctggtccgcgacgacgccgacctggcgggggtggcgatcggctcggccggccggtccggggtcggcaccggcggcatggtgaccaaggtggaggcggcccggatcgccaccgggttcggcatcccggtggtgctgaccgccgccccgctggccgccgacgcgctgaccggcgccgaggtcggcaccctgttccaggccgccgagtcgcggccgaccgcccggctgttctggctggcgcacgccaccgcgccgcgcggccgcctgcacctggacgcgggcgcggtcaccgcggtggtggcccgacgcaagtcgctgctgccggccgggatcaccgcggtggacggttccttcgccgccggcgacccggtggacctggtcgacgccggctcgggcgccccggtcgcgcgcggcctggtcaactatgacgcggtcgagctgccggcgctgctcggccggtccactccggagttggcggccgcgctcggcccgggctatgaacgagaggtcgttcaccgcgacgacctcgtactgctgtgaaaggtgtgtcatgagcgtgctggagcaggcggccgcggcccggatcgccgccatcgacctggccggggccacccgcgcggacaaggacgcggcgctgctgctgatggccgatcgcctggtcgagcggaccgacgacatcgtcgcggcgaacgcggtggacgtggcggccgcacgggaggcgggcaccggtgaggcgatcgtcgaccggctggcgctgagcccggcccgggtcgccgcgatggccgacgggctgcgccagctggccgccctgcccgacccgatcggtgacgtggtgcgcggctcgaccctggccaacggattggagctgcgacaggtccgggtgccgttcggcgtcgtcgggatgatctacgagggccggccgaacgtgaccgcggacgccgccggcatctgcctgaaatcggggaacgcggcgctgctgcgcggttcccgctcggccttctcgtcgaacgcggcgatcgtcgcggtgctgcgcaaggcggtcgccgacgccggcctgccgatcaacacgatccagctgctcgacgccaccacccgtgactcggtgaaggatttgatgcgcgcccgcggcctggtcgacgtgctgatcccgcggggcggcgccgacctgatccgcaccgtggtcgaggagtccacggtgccggtgatcgagaccggggtgggcaactgccacgtctacgtggacgccgccgccgacctggagaaggcgctgtcgatcacgatgaactccaagacgcagcgcaactcggtctgcaacgcggccgagtcgctgctggtgcacaccgagatcgccgactcgttcctgccgctgatcctgtccgcgttcgccgaggccggggtgaccgtgcacggcgactcccgggtggccggctacagcgacgccgtggtcccggccaccgagcaggactggggcaccgaatatctgtcggccgacatctcggtcgcggtggtcgactcgctggaggacgcgctcgaccacattcggcagttcggctccgggcacaccgaggcgatcgtcagcgagtcgctgggcgcgacccggcgcttcaccgccggcgtcgacgccgccgccgtcgtggtgaacgcgtcgacccggttcaccgacggcggcgagttcggcttcggcgccgagatcggcatctccacccagaaactgcacgcccgcggaccgatgggcctgcccgagctcacctcgacgaagtacatcgtcaccggcgacggtcacatccgctgatccgcggcactccacgccgaccggcgagagccaccggcgtggaggtccccgtccggtgctggaccgctggaacgaagacccgaaatggtcagcggcaggcgcgcagggcggtcagggtgacgttcacgtcgaagaccgggccctcgttgctgtcccaaccgccgtccgagcgctgcgtctcgcccagccgcttccacgtgttgcgcagcagccagtcgtcgcccaggttgacccggcgcaacgcggccgccatcgccgcgacgtcggccggggccatgtcacccagccgctcgcccagcacgatctgcacccgcgacgactcgtagaaatactgctgctggtgcaggaggccggcgaggtgccagccggccgccaggaaggacggccaggacccgtccggccgcagctgcgaggcgacgaaggcagccgcccggccgagcacctcgccgttgcgcccgcgggtctggtacgggtcgctctcgacggctgccgcggtcagccagaagccggcgaccgacgtcaggtagagggtggcctccggctcgccgggcatcgcccaggccggagcctcgccggccagggactcgtgctcctgccaggtgccgtcggaccgctgggcgctcgcgagccaggtcagcgcccgctcggcgaccggaccggcctgcaggccgccgaggtcgtcgagctcgctgagccggaagcaggtggcgtcgaccgaggggacctgaccgtcggcggaggcgggccagccgccctcggacatctgaccgccggacagccggtcgatgatctccggggaggccggctggcccgtccgcagatagtgcagacgagcacgttcgaccgggtcgccatgggcaacgacgtacccgatggcggcatcgatatcgaccacgatagagaagctacccgtcgattctgtgtttcggcgaccggaccgtcacactttaggaggccgatgacgtgacatcggcctccccagtgcgtcagtacgacggcagcgacgggtccacggtgttgacccaggagacgatgccgccctggacgtgcacggcgtccttgaagccggccgccttcagcgcggccagcgcctccgccgagcgcacgcccgacttgcagtgcaggacgatctgccggtcctgcgggaatttcgccaacgcctcgccggagaggatctcccccttcgggatcagcacggcgccggggatccggttgatctcccactcggccggctcgcggacgtcgaccaggaacacgtccttgccggtgtcctgccagtccttgagctcacgcgcggtgatcgtggaaccggtcaccgcctcctgagcctcttcggagaccgcgccgcagaagtcctcgtagtcgtccatgaggtcggtcagcgtcgggttctccccgcagagcacgcagttcgggtccttccggaccttgatcttgcgatactccatctccagagcgtcgtagaccatcaggcgcccgaccagcggctcaccgatgccggtgatcagcttgatcgcctcgttgacctggatcgagccgatcgacgcgcagagcacgccgaggacgccgccctcggcgcagctcggcaccatgccgggcggcggcggctccgggtagaggcagcggtagcagggaccgtgctcctcccagaagaccgaggcctggccgtcgaagcggtagatcgagccccacacgtacggcttgccgagcagcacggcggcgtcgttcaccatgtaccgcgtggcgaagttgtcggtgccgtcgacgatcaggtcgtactgactgaagatctctttgacgttgtcgcggtccagcgcggtgttgtggatgaccacgttcaccagcgggttgacctcggcgatgctgcgcgccgccgactccgccttgggcgtgccgacatccgagacgccgtggatgatctggcgctgcaggttggactcgtcgaccgtgtcgaagtcgatgatgccgagcgtgcccaccccggccgcggccaggtagagcagggtcggcgagccgaggccacccgcgccgaccgcgaggaccttggcgttcttcagccgcttctgcccgtccatcccgacgtcggggatgatcaggtgacgcgaatagcggcggatctcgtcgacgctcagctcggcggccggctcgacgagcgggggcagagccacagttcactccccgggttcggtggtaaggatcgtcgcccattgtcgctcgttgagcgccgccacgcccatgacgtcggacacgggcccgacatgcgggatgcggaatatttccgggccggtcgttacgggcgcgcgtcgcctgcgtaccgctcgccgtccaggaacggccaggcgttccgggtgcaaccctccagaccgtacgtctgctgcagcatcaccggagccggttcgcccttgcccgggcacccttcgtggccgtgcccgagctgatgccccacctcatggttgatcgtgtattcccggtactcgcccaggtggccgtcgtactccgggatggcggtcgcccaacgctcagcattgatgatcacctggcccggcacccggcacgaggtgaacccctcggtgtgcaggccaccggccgcgcacatcttctccgaggtggtcggcgaggccaggaagacggtgaactccgcgttgtcggccgacttcggcacccggcgcaggcgcaccttgccgccgccgatccagctccgcctgtcgccgagcgtgcggtcgacggtccgggcgaagtcgtcgggtgcgacgtccccgaccgtctcctcgacggcgaccttgaaccggtgcaggtcaccgccggtgccgaggactgagccgcgcgaggtcacgtaccggaagtgcccggctttcccgttcgtctcgctcagcgccgaaccgcgctgctccgccaggtgatcacgctgcccgcggtccgcctcgggggcgccgatcggcgccgggcgcgccgcttccggctccgccacgggtcgctgccggtcccgcaactcatggccgacgaccaggacgagagcgacgaccatgacgtacgccaggaaggtgacccgtcggcgccggcgcagcagcttccggccgtccggggtcagcgtgccggattcctcgggctgcccgtcgacatccggcggcgcgtcacggtcgatctcgacgaccggcgtcgcaccgccccgcgcggtggggagatcatcagcgtgcacctcggccgcggcggcggtgttcacctcgacggcgtgtgcctctgccaggccggcggcgtgcgccccggtcaggccggcggcgtccgccccggccggagcggcggcgggcgccggaatatggccggactgctgcggatcgacgtaggccggttgctcatgggtcgcctgttcgccgaacgcggtctgatcggccggattcgcatacccggtgtgtcccatcgaggccgcaaatccgacatctcccgccagttccgcatattcgggataccccgcgctcccggcatcctccgccggccaggctgggtccatcccggccacgtcagaggcggccagaccggttccggccagatcactcccggccgcggcacgctcatcctcggccggatgccagaggccctccgggatgccggccggaagtcgcagactctccggcaggccggccggcgggtggtcggtcgttgaccagaaccaggcgtcgtgcgggtcctcgggctccggctccggccaggccaccgaccggtcatgcagatcgggatagacgcggggaatctccgcggtatcggacacgaactgcggcggaagggcgggccgcaggctgtccaggtccgcttccgaccatcggatcgcggcgtcctgctgtcccatcgcttgcgggtacgccgtcggccccgccgcttgcgggtatgccgtcggccccgccccttgcgggtacgccgtcggctccgtccctggcgagtacgccgtctgtcccgcctcggggtgcaccgcttgtcccgcgtcctgcggctgcgccggggtgtccgcggtcgtccgcaggatcggccggcggcggctggggcggtccggttccacgatcggctcggcttcggcgggcggctcctgctgctgcagccccgccccttgcccgtcgacggcggccgggtccggccgcggttcggcacgctgctcggacagtgccgccgcccgggccgcccgcatccgccgcatgctctgccagtcgacgggctgcggctcgacctccgccggagcatgcagctcagcctcggtgatgaccaccggctggtgatagacgtccacatcgggcgccgccgaagccgcccccgccgccgacgcacgcggcgccgtctcgaccggctgcccgtagacgtccacgccccgcgctgcctgcggacccgcatcggggaggaacgacggccggtgtccgtgtcccaccgaagcctctggcgaatgccggcgaagatccgccgcagcccagccggcatccgggactcccggtgcgccaggctcggcagcatcctgcctggtcgggacggcggaatcggtatcggtaggggtggcctgcgcggcccgggcagcagcctgggcagcccgggaggcggccaggcgttcggcggccagttccaggatgccgcgggtcatgccgggtggcaggccggtctccggatccaccgggggtggggccgggcgcggttgcgcatggcgcgcggccgaggaccgatccggcacccccgccggctgatccgccgacccgaccgacgacccgggtggcgccccgggcgccgatccgtgcagcgctccggccgccgacccctgcagcgctccggccgccgacccctgcggccctccggccgccgacccctgcagcgctccggcggacgggttgagccgcggcggggccccttcggcgcggtgccgagccaggggttcctcgccggacatccggtgccggccgcccgaagtttccaccggctcaccgctgcgtcggtgccggccgccggattcgtcgcggtccgagccggggtgcagcgccggccgagcgggctcaccgcccctgctgatcgtcttgcgcggcgtcgctccgcccgcgggcttgcgcggcgtcccggctgccggcttccgcggcgtcgtcccggccggcgacgcgtcgctggacagcgtcttccgcggccgcgccgcggtgctcgtctcggcggccaccgcccggctccgcgccggtacatcggccgcggtcttgcggggccgaccggtgccggatccgctggacgacgccgcgcccggtgcaccggagcgccccgcttcgcctgccgcactccgaccacgcgtcgccttcacagtgtcggcccgcgcggtcttcacggtgtcggctcgcgcggtcttcacaatctcggctcgcgcggtcttcacagtctcggcccgcgcggtcttcacagtctcggcccgggatgccctggcggcggccgtccgggttgtcttcgtgccgtccgtccgggttgtcttcgcggcgccggaccgggatgtcgtcgtggcgtcggaccgtgtggccttcttggcggtgtcggtcttcgccgtgatgacgcccttggccgatgtcgcggccgccgcggacgtcttcttcgcggggttcggcgtggtgcgggcacgccggccgccggcgggcggctggtcgccgaaggccgggtccggggaggcatttgtcgcgtttgccataacatccgccagcgtgccatgactcgacgcgcgtcacaggagaatcgaattccccaccggagaaaccccgcaccaccccgcccctcgaccggctggcggctgccggccggcacccccgcctcgcagcggacggcgccgccgggatccgcaccgccgcgatccgcaccgccgcgatccgcaccgccgcgaaccgcaccgccgcggaccacgccccgggaaccgggtcagtaggagcgggtcagtgggagacggacggtccggtgaacgggtggttgtcgaggcgcggccaggagtagggcacgcaaccgcgcagcatcaacgtctgctggaccatgaccggcgccgggccgcccggctcggggcagccctcgtggtggtggcccagctcgtgcccgacctcgtggttgatcacatacatccggtaggtggccagcgggatcttggcggcgagatacggcttggccgacttccggtagcggtccaggttgatgatcgcggcgccggggacgcggcaggacgtgtacgggacgccgccgatgtggatgttcgtgccaccccgctgacacatctctccggccgtctcccgggtcgccaggtagaccgtgaagtcggcgtgatcgtccgcgtcgaccatctgcaggcgcaggtttccgtcaccgacccagctgcgcgcgtcgccgagagtcgacaccaccagagtggcgaacgcgttcgcgtcctccccggagcccttctccacggcgacgtggaaccgacggatcgggcctttgccgccgagcacggcgccgcgtttcacggcgtacacaaaatcgccggaaccgtgcgtcgggaccgccccgggcacctgcaggatctcggggtccaacgaggtggggccggccgatggcggagccgaggtgtgttccagggtgggcgccgccgaggtcggcgcagccgacggggaggccgccggggacggcgtcgcggcggcggacggcgtcggcctcccggagtgccggaccgccaccgtgatgaccaccagcaggaccagcgtgatcgcgaacagcgccggccaccactgccgccatcgatcggtggcacgtgccggcggttcgagggtgggcgtaccggaagggaccatggtgcgcaccagcctcgcacacgagcgccattcacatggccccgtgccggatcagcggtgcggtgcgcggatgtcctccagcatgccgacgatcgcgcgggcgaccagccggggcacctccatctgcgcgacgtgcccgacgccgggcaggatcagcagccggctgtccgggatggtcctggccacctggacgggcacccgcgggtcgaccagtttgtcggtcagcccgccgatcaccagggtgggggcctggatctgggcggccagccgccactgcgagttgacgcccggcaggtacgcccgcaggaaactgccgacgaggccgcgcagggtgcccaggtaggcccgcggatagtgggcgacggtgtagcggagctggatctccgccatcgcctcggcccgccgctgcggatgcaccttgctggtgtcgccgaagcaggcggccagcacctgctcggccatctgttccgcggtgacccgggtgagcgcccacgccatcaggcgttcggcacccggcagcgcgagcagcggcagcaccgggccctgtgcggtgcgacgtgggtcgaggaacggcatcgccggggagatcagggtgagggtgcgcaccaggtcggggcgcagcgcggcgacccgtaccgaaatggacccgcccagcgagttgccgaccaggtgcaccgggccgcggccggacgcgtccagatagtcgatcagggtggccgcgaaggccggaatcgaatatcgcgggctggggtcgctgtagccgaatccgggcaggtcgaccgcctgcccgtcgaaccggtcggcgagcaggccggccaggtcggtgaaattctgggaggaaccgccgaggccgtgcacgtagaccgcgggctcggcgtccgggcccagtgccggggtgtcccgcacgtgcagcatggcgccgcccacctcgacccgtcgtgcgggccacggtggcggcacctcaccctccggcaggagcgtgtcctcgccggccagcatcgcgcctttcactacgccaacagtgcctcggcgcggcgattgaccgcggccagtgtggcgcggaccatcgcgtgccgatcgtcaccggtgaccacggccgagccggagagctgctcgacccagccgccaccggcgcaggacagcagcagcaccacgacggcgacctgggtggaaccgaacgagacggcggccgcgtgctcgacgaagcagcgggccgggccgtcggtgtgggtggagacggcgagcagctcgtcgaccgcgcccgcggtggcggtggcacacaggcgcagcaggtagccgtcgacggccgggccggtggcgacgccggaggcggtccggtcgccggcacgcagtcgcacctcgacggaggcgtccgcgccgaacgtgttgacgtgcacgttctcgatcaggacgcgggggccggggcggtcgccggggtcgagcgggcggggaccgttgaggtctcgcggggtgacagcggcacgctcggtggcgggggccggcggggtcgacaccggggcggccgagaccggggccggcgtgggcacgggtgccggcgacaccggcttgaccgaggcacgggccggccggggtgccggggtaggcggcggcgtcgggctggactgcagcggaccgggggacagcgggtcggcgggcagcggaccggccggcattccgccgggcatcgccgcgtccaggcccatccgctcggccagcagccgggcgacgtgtcggctcacctcggccgcgtcggcgccgtcggccaggtccaggcgcaggctgtgcgcgccggccggggtggctttcagcgaggcgtcccggactccgtcgacctcgcgcaccgcggcgaggatggcctgcacgtcgaagccctcctgccgctcctgggcgggcacgacgtccccgcggcgcaggtgcgtcgcgatgcgcgccagggcgggcgcctcggccgatggctccacggagggcggctccggaactcggggcacgtccggctgggccggcacgcgctggggcagggcgtcgctgggctcgcccagcgcggccgccacctcctccggtgtaccggaatatccggggaagaccggggcggggaaggcgggcggcgccgacggctcgtaagcccggcgggagaagctggaggcatcgtacgtcggcaggccggtgcgggcctcgttgtccaccgatcgctggtccccctgcggggccgccggctccacccggggcaggccctgcgcgagggtgtcgttgaccagcgcgtggcgggaacggatcggctcggacggcgcgtcggtacggctcaggggatctcccagggtcgggcccggctcggcgggctgccagtcgccccgggcggacgggaccggccggggcatcggcacggccgcgcgctgcgcggtggcggagtgatacgagtcgtcgaggtcgccctcgtacgggtaggggggtgcactgctcggggcgggcccggtggacgccgtatcgaccggacgcggccggtgaccgagaatgtcagccagacggctgcgttcagcgggccacggtgtgggctcggcggccccggaagggggaatctcggtggacggtggcgggtccacgaaccccggcggcgggggcacctgcgccggcacggcggagctgggagccggtccgaaagggcgtgtcgggctcggctgccggccgatggcgccgcgccgccacgggggcacgtcggcctcctgttcccgtgcggaacccgcgttcgaccacgggttttcgccgttcacccacccgttcacccgattgcggtcacgcgcgtcggcgccgttgccgccatgcgcggctccggcgtctccggaatgccctgtttcatccaccgcgtgctcctcgctcgcccccgctgaggctaccgtgtggttgcagtggcgataagttgcagcgtcgcgacaattgcccgcacgaccgcgacatgcgccgatccgggcaatccgcgtcgacaaaccgcggggaccgaccccctggaggttcaccagatatgaccgccgcgtccggcggggctcagaccacccgccccacccggctgcccagatcggcacgccgaaagcaactgctggccgccgctcagcagatcttcgtcgcgcacggctaccacgccgccgcgatggacgacatcgccgagcgcgcgggtgtctccaagcccgtgctctatcagcacttccccggcaagctcgagctctacctggcgctgctcgacacccactgcgacgcgatcatcgccaaggtccggggcgcgttggaggcgaccccggacaacaaggagcgggtgaagggtgccgtccgggcctacttcgacttcatggaccacgagagcgaggcgttccggctcgtcttcgagtccgacctgcgcaacgacccgcaggtgcgccagcgggtggagcgggtcgagcagggctgcatcgtggcgctgaccgagacgatcatctcggacaccgggctgcgccccgatcaggcccaactgctcgcctcgggcctcgccggggcctccggggcggccgctcagtactggttggcgaacggccgtcgtacgcccaaagctgaagccgagagcctcgtcgccgctctgatctggcgcgggatcgccagcttccccctccagggcggttcaacggccggaacggcaccggaaatcggatagcctttccaagcggtacacgggttgacagaggaggactccgtggaggtcaagatcggcgtgcaacagtcgccgcgtgagctcgtgctcgaaagcgcgcagaccccggcggaggtcgagcaggccgtgtccgaggctctggccaaggacggcgtcctttcgctcacggatgagaagggccgcaaggtgatcgtcccggtcaccaagctggcctacgtggagatcgccgaggcctcacaccggccgttcggcttcaccacccgctgaggtgacgggagggggccctggtgatcagggttccctcccgcaactgctctcgcgtacgtctgctatgggtcgggtagagtggagtctgtcgccgccggtgcccagtcgctggcggccccgcgtgtggcccgctttcgagcgtgcggcccgcgccacaacagaccgcgccccaggacagtcgacgggcgcaccacgagagggcacccgtaaaacttcatgaccgacattgagcaagctctcatccccgtgacgaaccgcgccccggtccgcccggacagccccaccttcgctgacctgggcgtccggccggagaccgtcgaggcgctggcgaaggccggcatcacgcacgccttcgcgatccaggagtacgcgctgccgatcgcgctgcgcggcaccgacctgatcggccaggcgccgaccggtaccggcaagaccctcggcttcggccttccgctgctggagcgggtcctcgccccgtccgagggcgccgacggccgccctcaggcgctgatcgtcgtccccacccgcgagctgggcctgcaggtggcccgcgacctggccgccgcgggcagcacgcgcggtgtccgggtgctgccgatctacggcggcgtcgcctacgagccgcaggtggagcagctgaagaagggtgtcgagattctcgtcggcacccccggccggctgctcgacctggccaagcagaagcagctgaagctgaacgcggtggccgcgctggtcctcgacgaggccgaccggatgctcgacctgggcttcctcgacgacgtcgagaagatcctggcgatgctcccggagcagcggcagaccatgctgttctcggccaccatgccggacccgatcgtggcgctgtcccgccggttcctgcgcaacccgatgaccatccacgccgggcacaccaccgacagcgggccgaacccgctgaccaagcaggtggtctaccgcacgcacccgctcaacaagatcgagatggtgtcccggatcctgcaggccagggaccgcgggctcacgatgatcttcacgcggaccaagcgggccgccgacaaggtctccgaggaactggacttccgcggcttcgcggtcgccgcggtgcacggcgacctgggtcagggcgcccgtgagcgcgcgctgcgggccttccgcagcggcaagatcgacgtgctggtcgccaccgacgtcgccgcccgcggcctggacgtctccggcgtcacccacgtgctcaactacgactgtccggaggacccggagacgtacacgcaccgcatcggccgcaccggtcgcgccggcgccaccggtgtcgcggtgacgttcgtcgactgggaggacatgccgcgctgggtcctgatcgacaagtcgctggtgctcggcatgccggagcccccggagacgtatcacaccagccccgcgctctacgccgacctggacatcccgtcggacgtctcgggcacgctgccgaccgcggaacgcaaccgggccggcctgtcggccgagatcgaggaggatctcggcggcggtggccgcggccggcggtcgtcccgtccggcacgcctagctagctagacccgccatccacgacccccgcgcctcacaccgccgcgcggcccttgcaccgcgcccagccagccccgcgcctcacaccgccgcgcgcccttgcaccgcgcccagccggccccgcgcctcacaccgcagggcacgccgacaccgccacgccgatcaccacgcgcctggtgctggcccatttcccgggaccccacttctcgcggggtacatccgccgctgacgtggcacggttagcggcgccggctgagcgcggcggaggggctggatggggcggtcacgcggcttacgacgtactctaatcggatttttgggtgtttagagccatcgatcggctaagtcggtcagcaggttgaccgagagttggccggccgccgtcacctcggccaggaaggcgtgctgctcggcccgacaccacggcgtcgcatccagctgccggtagtagcaggccgggaagagctccgggtcgacgccctcgaagacgaagaagcggtagccctcgcggcggaatcgatacacttcgaggacggcggcgcccagccattgaccaccgtcgaggtcgccgaggtagcgggcgccgtggtgcgcgacgaaaccggtggcccggtcgaaggccgcggatcgcaaccgcgtgcattaggtggtcgtggccggcagtgcggcgatccgcccggtccagcacggaccgtgcagaaagcgcaggtcagcctcgatcgccggcacccggaagagctccgggaagtggaatcggccggccaccggatcgcaggccatcgcggccgtggccaactccagcgactcgtagacgaaccagtgctgggcgacgagctcggcgtaggcggcgatcggcagccgcccgccggccagggcgacgacgaaacgatggtggcggaccgcggcgtacgcctcgcccagaattctccgcagttggccggagagcatgccggtgtttggcggatccgccagtgaccacatcggatgctcccccttccgcgtcgacgatcaaactagcccccgcggggcgcccatggcgaccgggcagaatggtgggatgccacaaccgctcgaccaagccctcgccgaggtgcgcgaactgctgctcgcccccggtctgacccgtgccgtcgcggccgggcggcgccgcggacagctaccgtcggtgacccgagcccagctacggccggtgactctgaagagcggtccgaaattgcagatcgtcaccgacgacggtgcccgacccgccacccgcaacgtcacacccggcgcggaagcggccgccgcgatcgacgagctgctcgccgagccgttcggcaactggcacatcgagaccgattccgccaccgtccaggtgcggatcaccaagaagggcgaggcccaggtgcaccgcgcggcgaccgtcgcggcgcccgtcgcgcaggaccacgaccgggcgaaacagtggctgctcgacccgggtgacccgctgttcgaggtgatcggcggcaacgccgcgaaacggcggcagatcgacgcgttcctgcgcgcgctcgccgcgacactgcccgacgagctgccgccgacgctccgcgtcgtcgacctgggctgcggaaacgcttatctgaccttcgccgcctaccgctatctggccgggcgcggcgtgacactccagatcgccggggtcgatgtccgcgaggatcagcgggtacgcaacaacgcggtcgccgcccagctcggatgtgcggccgaggtcagcttcgtggccggcaccatcgaggaggccgagctgccgttcacccccgacctggtgctcgcgctgcacgcctgcgacaccgcgaccgaccaggcgctggcccgcgcggtgcgctgggaggcgcgctgggtgctggccgcgccgtgctgccaccacgacatcgcggcccagctcaagggcggtgcggcgccgtcgccgtacgcggagttcacccggcacgccatcgtccgggaacggttcgcggacgtgctgaccgactcgctgcgggccgcactgctgcggttgcacggctaccgggtcgacgtggtggagttcatcgactcggcgcacacgccgcgcaatctgatgctgcgggcgcggcgcagcggtgcggcggcgacgccggagcagcacgccgagtatgacgcgctgatccggcagtggggcgtcacgccggcgctgtcccggctgctagccgacggttagggtccactccgcggtgtgcacctgcccggcgacctggaagtcgaagaacatccggtagtcgcccgggccgggcgcggtgacccagaacttgaccttgccgtcgaccggctgcagctccgggtggatgtgcagataggcgacgtcgccgcggcgcagcacgaccagatgaccgaaagcgcccagatacggctcgacggtcgccgggcggccgtcggccccggtcacactgatcaggacgggttggacggcctgggtgttcggcgcgccctcgtaactgaccgtgaatccaccggtggtggtccgacggtcggccggcgggagcggctgcggcgcgtaatcgccggcgacggtgagatcggtgccgagtgtggtggcgatctgtcggccgccggccagcgcggtgaaatcggtgatcatgcggtaggcgccgggccggtccagggtcagatcgatcgaccaggtgccgtcggtggccatcgtcggatgcaggtgctggaacccggtcaggtcgcggcggacgatgatcaggtgcagcggtttgtcgtggacgatcgcgtacgacgtgaccggggcgccgcccggaccgtcgatcacgaagctgaggcgcgcgcggtgaccggcgtcgaaactggtggcggccgggtgcagggtgagtccgtcggagctgagggagaggccgccgagcgccgcggccatggtgacgccggtgccggtggtgccgtgggtgtgcggcatgttctcgttcatgaccatgccggtggtggggctggggccggcggcggccggggtggcggtgccgttgttgaggcggcccaggccgtagccggcgaacaggacgacgatgagcagggcgccgaaggcggcgagccggaaggtgtttccgctggggggatgctccggctcgtcgtcctggtgcagggcatcgtcggtcgtgtccgggagtgaccatctgccggacttgacggacttctgcttctttatcgcactctgcggttcggggacagcgggcgtcgggtcggctgccctgccttcgccggctaattcgcccctgtgggtcgtggcgtcggcgccgggctggtcaggcatccgcgagctggtagccggcctcgtcgaccgccgcgcggaccgcgtcgtcggtgagcggcgcctcgctggtcaccgtgacaccgccggaagccaggtccacgctcacctcggccacccccggaagcgccgagatctcctcggtcaccgcgttgacgcagtgcgagcaggtcatgccctggacggtgtaggtgctggtgacagccatcttgaacgcctttcactaccgttgcacatggttagtcgctcgacgacccgctcgggttccgtcaggatttgatcagtcgggcgatcgcgttcgacgcttctttgaccttgtcggacgggtccccggcgcgtgccgcatccaccacgcagtgggccagatgatcctccagcagcccgaccgcgaccgcctgcagcgcactcttcgccgcggagatctgggtcaggacatcgatgcagtacgtgtcctcgtccaccatccgctgcagcccgcggatctggccctcgatccgccgcagccgcccgagcagggcagccttgtcccccgagtagccgtgcggaccgtgccccgtgttcgcctcctccgacatgcccctagcataccccccgccggtatccgcgggacttgcgtaccgttcgccggacattgtcgtacccgaccgttagattgccgccgtgacggaatggcaggtggcacaccgatccgctctcgatcatgtcgtgacgctgatcgccggctccgagtgggccgagacggtggtcctgcgcggcagcatggcgatgccggcctgggtcggcgacgccgcccgcccacccggcgacctcgacctgattctgctccccagcccgatcgtcggcgtcgacacccgcgagccgtggccgttcgtcccccacctcggcccgtcccagcattggccggaggccgtccacggcggcgcccgcaacgagatctggaccttcgaggagttcgagaccggcggcctgcgccccgtcctcccaccggagggcctgcactggatgaccagcctcgacgtgtccgagccgttcgacttcgcccaccagttcctgatcgacctgctcaccgggcatccccgcacccccgacggcgtcctgctcgacctcgacgccgccaccgagaacctcagctgggactacagcgaaccggacgaatacaccaccaccagcgagaacggccgagcccggctccgcatcccgtggaccacccccgccggccttcccggtcacatgcagatcgatttgtcgtacgacgaaccactccccaccccacccgtcctgaccgccgtgccgcgggtcgccgccccgccgatcgccgtcctcaccgccggccgggagctctccctggcctggaaactccactggctggccgccgaccagcagtcggagggccggtccgccgccaaagacctgtacgacgccgtcctgctggccgaactcccccagatccgcctgcggccccgcctgcagcggctggcgctgccccagcccttatcaccgaccgccctggccggctggaccatcgacggcccgctacccggcggcccggcgccctggctgacccggctcgccaccgccctcccccacctgaccgccgcccctgccccatgaccacgccagccacccgcgctgccccactgccgacaccaccgcgcgacgcgtcccgccatcgcgccgcccctcccccacgaccacgccagccacccacgctgcccccttgcccacaccgccgcccgacgcgtcccaccaacgcgctgcccccgcgcgacgcgtcccaccaacgcgctgcccccgcgcgacgcgtcccaccaacctagctagctaggcgacgcgtctcaccaccgcgccgccgcccccgcgcgacgcgtcctaccaccgcgccgccgccccgcgcgacgcgtcccaccaccgcgccgcgcggaggaaccgtgctcggtcttgtcccaggcatcaaccggagctgggtggcggtgctgtgacctgcgcttcgccaggcggtgggaaagcgttggcgcagccgcccgaaccgcatggcaccatgcagcaagttcggaatcgctgaaggagcaaccgtggaagaccgcgagaaggacggctacgtcctcaccgacgatgcaggccgggtcgacatcgatcgcgtacaccgctggctggccgaggagtcctattgggctaccggccgcccgctcgacctggtcacccgctcgatcgacggctccgtgccctattccatcctccacaatggcgagcaggtcggtttcgcccgtgtggtcaccgacggcgccaccttcgcctgggtctgcgacgtcttcatcgccgagtcgcaccgcggccacggtctgggcgtctggctggtcgacaccatcgtcgaggacatgaccgcccgcggcatcctccgcctgctgctcgccacccgcgacgcccacgaggtctaccgccgctccggcttcaccccgttggaaggccccggccgcttcatggaaatcgaccgccgcccgacccgcaacgccatcctgggccgctcctgatccgcagccacccaccccgctgccataggcccagccacccaccaccggacagagcgcctcatccaccaccggacagcgcgccccatccaccgccggacagcgcgccccatccaccgacagacgacgcgccatccaacgccggacgacgcgcccatccaccgccggacagcggactccatccaccgccgaacagcgcgcccatcatcgccgagcagcgaacctcgctcaccgccggataacgcaccatcccaccgtcggagagcgagcctccccgcgccagtcgaagcgggtcaggccgcagaagtgaccgagtccgcccgcccgccgaagcggacccggcggcagaagcgaccaggtcgcacccgccagacaaggcaggcccgcagcagaagcaacaaggcccacccgaccgacgaggtaggccgggcggtggtcagctggcgacggccagggccagcggaaggacggagtgggcgccggactggcgtagggtgcggccggccagggccatcgtccagcccgagtcgaccaggtcgtcgaccagcagcagcgggccctggtgaacggtgaggccggcggcgacctcgggtggaacggtgaaggcgttgtgcagggcgcggacgcgctgggcgctgttgccgcggaacgtctcctctccggaaccggctgaggtgaggacgccgagcaacggtaggcggccgaccgttgcgatgtgctcggcgaggctgtggacaagttgtggatgacgtcgtgagccgaccgccacgacgccgaccgggcgctgggcccaggcgtcatcgccgcgcgcccacgctttgaggacctcgacgaccgcggcggcgagctcggccgggatcggtgcgtccggggactcggggccgaccacgccgcgtaggcgggcgccccagccgagatcggagaggcggccgacggcccggcccggctcgacctgctcggccggcccgatcttgcccttcagcgagatgccgaccgcggtcatgccggtgggccacatcttcttcggcgcgacctccaccccgggacggccgaggaacgcctcggcggcggccagcgagccggccgacacgtccgggccgaagagcggctcggcacagttgtcacaccggccgcacggtgtggcctccgggtcgtcgaggcatctgcggaggaattccatccggcaggtgggggtcacggcgtactcgagcatggtttgttgctcggcggagcgcgcctcggcgacgcgccgcaaccgggcggtgtcgtaggtccacggctcgccggtggcgagccagccgccacgtgtgcggcggaccgccccgtcgacgtccagcaccttgagcatcagctccaggcggttgcgccgcagatcgaccaggggctccagggcctgcgtggacatcggccggtcggcggagagctgggccagcaccgaacgcacctgatcctccggcgggaaggccagcgaggcgaaatatcgccagatcgccgcatcctccgggccgggcagcagcaccacctcggcgtgctcgacggcccggccggcgcgaccgacctgctggtaatacgcgatcggggaattcggcgcgccgaggtgaacgacgaagccgaggtcgggcttgtcgaaacccatgccgagcgcggacgtcgccaccaacgccttgatcttgttgtccagcaggtcctgctcggcggcgcggcgctcggcgtcgtcgacctggcccgtgtacgaagcgaccggaaaatttcgggaccgcaggaagtcggcggtctcggtggcggccgcgacggtgagcgtgtagacgatgccggagccgggcaggcgctccaaatggtcggcgagccaggccaaccggtgtgccggctcgggcagccgcagcaccgcgaggcgcagcgaatcccggtcgagcggcccgcggagcaccagcgcgtcgccgagctggtcggcgacgtcggcggtgacccgggcattcgcggtggccgtggtggccagcaccggggtgcggccgggcaggccggccaggaaggtgcgcagacggcgatagtcgggccggaagtcgtgaccccagtcggagacgcagtgcgcctcgtcgaccacgagcagcccggtgctgtgggcgaggccgggcagcacgttgtcgcggaagtcgggattgttcagccgctcggggctgatcagcagcacgtcgaccgtgccggcccggatctcctgctcgatctcggaccactcgtcgaggttggccgagttgatggtgcgagcccggatgccggcccgggcagccgcgtcgacctggttgcgcatgagcgcgagcagcggggacacgatcaccgtggggccggccgaaccgccggcccgcagcagggcggtggccacgaaatagaccgccgacttgccccacccggtgcgctgcacgcacagcacccggcgccggtcgacggtgagcgcctcgatggcacgccactgatcctctcgcagtctcgcgtgctctccggcgagccggcgcagcacctgctcggcgcgctcccgcacactcgcccgctcggccgcatcggctgtcatccgcgtcgtctcggtcacccggcatgtctatcagccgccaccgacagaaccggagttatccacagtccggggttatccacagaacgaggagaaagtcgtgcggcggtcgccgcgccgggccaagctgctgggcatccgaacttctcgcgacggggaggaagcgatgcgagccatgacggcagcgagtcgacggttccgcccgggcggaacgccgcacccggcccggtcaccgccgcgccggcggccgggtgaccggctggcatcgaccgcaaatccgacccggacccactgctgaatggaagtctcagggcatgagcaaaacgatcgccgagaagctgttgatcaagccgaattccaccgtctggctcagccagccggcacgcctgccgctgctcacaccgatgccggagggtgtgcgcgagaccggatcgctggccgccgccggcaccgctgtgctgttcgccgaggatgccgcctcggtgcgcgcccagctcaccgagcaccgggccgacctggacaagccgagtgccttctggatcgcctatccgaagggcaacaaggcggacatcaatcgcgacacgctgtggccgatcgtggccgatttcgacatgcggccgtgcggccaggtggcgatcgacgaccgctggtccggtctgcgcttccggccgaaccgtcccgatgagggccgattcaccggaggcagccaatgaccagccgggcgccgcttcggtggccggccgtcccggccaccggggcacccgctcagcggccgaccggtgcacgccgacccggcccgacagcggccggatcagcggccgaggaccgtcccgccgttgacgttgacgatctgaccggtcacgaaaccgccgcccggcccgaccagccaccgcaccgcctcggcgatctcctgcggctcaccggcgcgcttgaccagtgcggagtcgacccgcttggcgtgcccctccggcgtcatccggccgtcgaagaactcgctgtcggtgatgtatccgggcgagatcacgttggctgtgatgccctccccgcccaggttcaccgccaggtccagtgcgtagccgtgcagggcggatttcgccgcggaatacggccccccgcccccgcgctgggccgcgatcgagctggtcaggatgatcttgccgcccggccggcggagcagtggcagcagcgcggtggtcgtcagcaccgcggtgagcacgttggagtcgaggttggcccgccagcgtgcggccacgccgtccagcgtgctgtcgtcgccgccgatgaacgcgccggcattgttgaccaggacgtccaccgcccgaccggcgaccgcctcgacgatccgggggacctgcgccgggtcggcggcgtcggcggtgaccgcggaggcctgcgggccgatccacttcaccgcgtcggcgagcacctcgggtcgccggcccacgatgatcacgtcgtagccctcgccggccagcatgccggcggtcgccttgccgattccggtgccaccaccggtgaccacagccagtcttgtcatgatcccgaccctatccggcccgcttgggcggttcggtcaaagggcgagagagaacccgctgttcggtttggccggggcggccggcgacgggtcggccggcgacggcgcggccttcctccgggcgccgccatgccgggacggtggccgcttgcgctggtggatggtttcctccggccccgggcgatcatccttggccgaggcggcgctcaccgcatcgtccttggtggccgggtcactgaccacgccgagcacctcggcccggcacggatggccgttcatggcgaaggcgagcggcagcgggttgcggtcccggtaacccccgcgcagcgtgatcacccggctccggccggcaccgcgcaccacgacacgtcgaccgtgctgggcgaccgatcggggcggtccggccagccgctgcgtaccggggaagctgaactccaaccgccagccggccgagccgccggtggtcagcacggtcatccgcgcttcaaaggcaccgcccgagtcgcgccgcacctggtactggaccgagcaacggacccgctgcgtggtgtccgcgcccgggccggcggcggaggcgctggactggtcggcgtccgcggcctcccgccgggccgaccaggtcaacgcgctaccggccagcagcaccacggtggccaaagccgcggccgccgacaaccggttccgggcgcgggccgggcggccgtgccgcacccacgcggcgaccgcgccagcctggcgcaggcgcgagccgagaaacaacccattaccgaggggatgcaccgcacccgtccgcagcacggtcccgaatcggagagcggcccgcagccgcagttcacggagccgcaagcggcacgacgggccggacgaccagggccggcgatcgggcaacccgggcccggactccgcgacactgccgtacgaagagccggaccgcccggaggcaccatgcggcgcggcgggccgccggagtctccggtgcggcgagccggacagccaggacaaccgggcgcggcgcggcgcctcggagccggccggggcgggtaccaccgcgcgggcgaccgggacggccggacgttccccggggcgcagcggcgggatgatcggccgcaccccgacggtggccgccaaggcccgggccacctccgcggagaccggccggtcggccggggctttggccaggcaccgcaggcacagatcagccaccgcggccggcatgcccgggacgtcggggaccggatcggggtcggcgtagagatgggcgcggagcgcctcggtggtgctcgcggcgggccacggcatccggccggtgagcgcgcggtagagcagcagcccaagggcgtagacgtcggtggccggagagaccggcgccccgccgaggcgttccggggcgaggtaggcgggcgtccccagcaggctgccgtccgggccggcgtcgcgctgcccgaccaccgccgagatgccgaagtcgaccaccttcgcaccggccccggtgagcatcacgttggccggggtcacatcccggtgcacgacgccgcgggcgtgcgcggtggccagggccgaagcgacctcggcgcagaccatcacggcttcgcgccagtcgagggtgccctgccggcctatgcgcgcgcctaccgactccccgtcgttgagttccatcaccacatacggaacggtcagatgatcagaaagcagagcctccccgaagtcgtagacgccggtgatgtgcgggtggcacagccgggcggcggccagcgcctcctgccgaagccggtcacggaaggcacggtcggtggccagttgcggggtgagcaccttcaccgcgacgtcacggctgagggtctcgtcgtacgcgcgccagacgaccgacatgccgccggtgccgagcttctcgacgaggcggtaacggccggcgatccgaagcgatccctcgtgaccgtttcgctccgtacgccccatgcgccgattctcgcccgagggactgagtctccggtgccgcactccgaaacccgcccggattctccgagcggaacgcccaaaacacctcaaacctcgccccgtgccgatccggtgaccggtgaccgaccggcccgcagccgggacgcgaagccgtggcgccggcgatgtcgctggttgcggtccggccgctgaccgagtggccggaaacgacgacgcccgccccgagagccggggcgggcgcgcgagacaccggagcaggtctagagcatggaaaggtgcacgtggttggtatgaaccaccgacggaccaccactggcgctgtaggcacgccagcccgtgctgggcatccagatctggcgataccagatcacgtacatgatgccgagggcgtccgcgttcttgacgaagtacgcggcgaggcgatcgccgtacgccttgtcgctgccggtcgccgcggcgtccttgaaggtgctggggttggcggagaaatcgcaggcccggcccttcggatgttcaccggagtcgcgctggctccagcagaccgtgtaatgcgtgaagccgtccgaccgcgcctcctgataggcgtgcagggtccgcggcgtgatgcagccggtcgaggtcgggtcgtcgaccgtgcatgactccttgggccaggagccgtccgagttgcgcggcgccggggcggccgccgccgagtcggcgctgacgaagccgcccaccgaaccgccaccgaccgccccgagagcgatctcggcctgcttcttcttctgcgccatgacgttgacctggcggttctgctcgatgatctcggcagacagcgcggtctgcgccttcttggtggtgtcgatgtccgtcttgtacgcggcgagggtgctgccgtcgagctgcgcgagcatgtcgaggccctgcacccgctccacgaaactgtccggcgagccactgttgagcagcagcatcatcgtgttcatccggcccatctggtacgagcggttcgccacggcggcgacccgcctggtgaggccgtccacccgggtctgcgccgccttcagcgtggcggtcagctgcgtctgccgtttcttcgactcggccagtttcgtcttcgccaggtcgtaccccttggcggccgcttccaggttggcccgcagcgccttggtcccgccttccgggtcggcggcacgggccggcgtcccggacacgacgagcacggccgcgagggtcgcggccaccagggcggcgaaccgggccggtcgccccgaccggctgaggaacagtccaccgcgccgccgaataacggcaaatggggcgcgcgtggagtcggcgagcaggtcggtgcgccggcgcggggggaaggccgccacggaaaacctccaagtcgggagcgcgggtactttaccgtgccgggcctggagaaagggagatcgatcaggtcgccgaatatccaccgtcgacgaagagtgtctgaccggttaccgcttggctcgccccgctggccagaaaaacggcacatccggcgaaatcctcgggcaacccattgcgaccgatcattgtccgagcggcgtgcgccgccactttcgagggatccccgaagacgggttcggtgagtggggtgtgcaccactccgggggcgatcgcgttggcgcacacgccgtgtcgcgaccacgcctcggcctgcgagcgggtcagtccgaccaggccggccttggccgcaccgtacgccccgctgttgccgtaggcgcgaaaggcctgctgggaggcgatgttgatgatccgcccccagcctcgggcggccatccccgggccgaacgcctgaccgagcagaaagggggacgtcaggttggcctccacggtcaggtcccagacgtcctcggccagctcgtccaacggcggtcgcaggttcacggccgccgaattgaccaggatgtccggctcgccgtaccgcgagttcatctccccgaccgcggaccggaccgccgaccggtccgccaggtcggccgtgatcgccccaccctcggcaccatgtttttccagctcagcgaccacttcggcgagtggccccgcacgccgggcgagcagcacgacccgggcgccggcgcgacccagcgcgagggcgatctcccggccgatcccggagctcccaccggtgaccagcgcagttcgcccattcagcccgaaaagctcatccaggtacgaagtcatactccgcacggtagatcgctgagtgaccgtgcgagatcccactgtgagatccgacactcaccccgaaatcagtcctcgatgacgggcggtccatccgggaaaagagtgttctgcacggtatgccagatctcctcgttgccggcgaccagcagtcccttgcgacggttgatcggcatgtactccacgccgtcgaggtgtcgggcgacgccgccggcctcgcggacgatcaacgtgccgggcgcgtggtcccagggcaggatccgccagaacatgccgaactgctgcgcgtcggtggcgatcgccgggtattcgtatccggcgcagtgccggcccggggtgtacccgccgagcgcgcccgcgtgcgcgtcgatgtgcgcctgcatgtcgggcggaaagtacttgttcgcgatcaccccgtgcaggtcgccggccggcgggtcgtcggcccgggctttgacccgcacgccgtcgcggaacgtgccggacccggcctcggccacggtcaggctgtcctcgaccacgtcgaggatccaggcggccaccgtctcgcgctcccgcaccagggcgaccatcacgcagaacggcgtccgcccggcggcgaagttgttggtgccgtcgaccgggtcgacgatccacaccgcgccaccctcgtcgatccggtcgcggacagcgggatcggcggcgaccgcctcctcaccgaccaccgtggacccgggcagcagggcggtcagtccgcgggtcagcgcccgctcggactcctggtcggcgatggtgaccaggtcaccgggcgctttctggtgcacgtcggcgctgtccagccgctggaatcggggcagcaccaccgtctgcgcgacctcacggacgaggtccgaaacctggtcaagcacggggcggcagcttcacgacgctgacgaagaactcgtcgatctggcggatcaccgcgatgaaccgttcgaagtcgacgggcttggtcacatacgcgttcgcgtgcagctggtaactgcgcaggatgtcctcgtcggcggaggaggtggtcagcactacgaccgggatccggcccagatcgtcgtcgttcttgatctcctcgagcacctcgcggccgtcgcgcctcggcaggttcaggtcgagcaggatcaggtcggggcggaccgcctccgcgaactgtccctcgcgacgcaggtaggccagcgcctccgcgccgtcggagacgacggtcagccggttgcggaccttgtgctcctcgaacgcctcctgggtcatcaggacgtcaccgggatcgtcctcgaccagcaggacctcgatcggtgtgccgctgtcccggaattcggtgctcacacccccaccgcctctcgctcctcgtgctcctcgccgggctcatccaggccgatcagcgccgggagcgtgaaccagatcgacgcgcccggagacacgtccacatccagccagatccgtccgccatggtattcgacgatcttcttgacgatcgccagtccgataccggtgccctcgtaagcgtcccgggcgtgcagccgctggaagatcacgaacaccttgtcggcgaactcggcctcgatgccgatgccgttgtcccgcacgttgaacttccactcgctgccgtcgcgttcggcggtgacccgcacccgcggtgccacatccggccgccggaacttcagcgagttgccgatcaggttgacgaacagcgtggtgagcagcggctcctcaccctccacagtgggcatccgaccccaggtgatctcaccgtcctcgccggcccgggcgtccagctgcgatttcacgtcgccgagcacccggtccaggtcgacgtcggtgaagccgctggtgagccggccgatccgggagaacgccagcaggtcgttgatcagccgctgcatgcgttgcgcgccgtccaccgcgaaaccgatgtactggtcggcgcggtcgtcgagcttgccggcgtaccgccgctgcagcagctggcagaagctggccaccttgcgcagcggctcctgcaggtcgtgcgaggcgacgtaggcgaactgctccaggtcccggttcgaccgggtcagctcctcggcctggctctgcaactgctggttgacccactcgacctgctggcgggcgtcgcgcacctcggtcagttcggtggcgatctgctggcgcatccggtcgatgtccgcggccaggccgaccagctcgggcgcgccgaccgagctctcgatgtgccgttcataatcgccggccgccacgtcgcgcacctggccggccagctccaggatcggccggctgatcagccggtcgagcaggagcagcaggaagatcccggcgagcacgacgatcgccgcggcggcgatctcgatggccaccatggtgtgactggactccttggcggcggccgcgctgtgcgcccgcagcgtctggatgtgcgtctgcatcacgctcagcgcgtcacgcaccgcgtcgaactgccgggtgtccccggcctccaccttggcctgcccggcggcggccccctggtcgcgcacggtcgcgatcaccggctcggcgacgtcgcggtgccagtcgtcgatccgcgcgcgcaccgcggccaggtccgcgcggatctggccgtcatcgggacgcaggaagccatcgatccggctgacctgggtgttctgctccaccagaccctgacggtagggctcgagactggcgtcccgcccggtgatcgcgaagccgcggatcccggtctcctggtcgaccagcgcggtgcccagcgtctcgctggccgcccgcatcgggctcacccggttcagcacgtcgtcgagctgacggttgtgggtggccgcggtggtcgcggcgaagatccccagagcggtcaggatcaggccgacgaccgcacacagcgcgacgatccggccgcgcagggaccaggtgcgtacgttcatcgcccaccgcctcgcgagatcagcagcatcgccacgtcgtcggtcagcgggccgccgttgtcctggtcggcacgcccgaccagccaggccggcaggtcgctcagcggcacctcgcgcgcggccggctcgtccagcagcttgcacagcccgtcgacgtcgaggcgctcgttgccgggcccggtgtgcccctcgatcaggccgtcggtgtacatcaacagggaccagtcatcgccggtgaactccagctcggttgcgggtgtcggggtgggacgtaccccgagcacgatcccggtacgcgcgtgcaccggcccggcccggccgtcggtgagcaccaccggcggcggatggccggcgagccgcacggtcgcccggttggcggccaggtcgatggtggcggaggcgaccgtggcgaacacctcccgcgcccgccgttcgctcatcagcacctgctccagcgaggccagcacctgctcctcgggcaccccggccagcaccagcgcccgccaggcgacccggagctcgacgccgagcgccgcctcgtccaccccgtggccgcagacgtcgccgacgatcacgtgcagcttgccgccggtctgcaccacgtcgaagaagtcgccaccgagcagcccggccgcccgcccggagcggtagaaggtctcgaccgtcacctcggtggtctgcatcagcggctggggcagcagaccgcgttccagccgggccgactcctcctgccgcagctcgacctcgcgcagccggcgggcgttctcgtcggcgcgcttgcgctccaccgcgtaccgcagggcgcggaccagccagaccccgtcgacctggcccttgaccaggtagtcctgggctccctcggccaccgcctggacacccaggtgctcgtcggagcggccggtgagcacgcagaccgcggcgttgccggcgacggccagcagtttgcgcagcccgtcgatgccctccgcgtcgggcaggccgaggtcgagcagcacacagtcggcgtcggcgaccaggccgcgcgcctgccggaggctgctggccacggtcagctcgaacggggcctcggcctcgctgagcagctcacggacgaggaaggcgtcgccctcgtcgtcctcgacgagcaggatccgcagccgctccatctgcgcgagcgcgtgcgcgcggggtgcgaacgaccgttccatcattcccaatcccgactcgacgcagagctgacccggaaatcgtgtaccacccggcgcggcggcacaacatcggtcaccacctcgtgacctgtcctcacgccggcccgctgggagcgttgccatcgccggccgcggccacccggcgcacatgctcggcgatcacctgtccgaggatgccgtgcagccgtccgcagtcccggcagtgcaggttctcgtcgaggtggcgaccgccacactcgacgcattcaccgcggtcctcggggtcgcgataggactccagagcacggcacatcgcccggatgacgtggtcactcagggcgaaagtctggtcaccgagcgcggtgcgcaggccgagcagcgccaccggcgggacctccggttgtgggtcgtagggggccaccgcgtcgatgaactccgcgatgacggcggccgggtcgaacgaggcagtcaccccgacaacgctattgcacgttgcatttgatctaccgggtacccggatgtcgtacccccgcgcttagatgtcacccatgcgtgacgccgctctcctccggccggctcggcgcggcttcgccgccctggccgtcctcgccgtgctggccctcgggggcttcgccgcggttcgctccatcctgccaccggcggcggctccggcctcggcgccgggcggcgagttcagcgcggaaagagcatttcagagcgtgcgtacgatcgcagccgccccgcatccggccggttccgcggcgaacgacacggtccgcgaccacctcctgcggaccctgcgcggcctcggcctcagtccgcaggtgcaggacaccgtcaccgcgcagggcggtgagctgtcggccagcgcgggcggcaccggcctggcccgggtccgcaacgtggtcacgctgatcccgggcagcgcctcgaccggacgggtgttcctggtggcgcactacgactcggcgcagaccggcccgggcggcaacgacgacgcggccggcaccgccagcctcctggagatcgcccgcgccctgaccacgggtccgaagctgcgcaacgacgtggtgctggtgatgaccgacgccgaggaggcctgcctgtgcggggccgaggcgttcgtccggcagaacccgttggccgccggcgggggcgtggtgatcaacctggaggcgcgcggcagctccggcccggccatcatgttcgagacctccgcgcggaacgcccggctggtcgacgcgtacgcgcacacgccggacccggtgggcacctcgttcgccgtcgagatctaccgcctgctgcccaacgacaccgacttcaccgcgttccgcgaggccggtttcaccgggctgaactcggcgtacatcgacggcgccgccgtgtaccacgcgcccaccgacctgcccgccgcgatggaccgggacagcctgcagcaccacggggcgaacgcgctggcgctgacccgcacgctgggcgacaccgaccggctggccgccgccacccgggccggcggcgacgccacctacttcccggccctcggcctgctggtgcgctacccgggcggtctggtctggccgctggccggcctcgccgtgctggcggtcgccgcgctggcctggcgggcccgccggacgggccggctgaccggccggcggctggccctggccgggctgctcaccctggcgccgatcgtggtcgcgccggttctggcacagctcttctggaccgtgctgaccctgatccgcccggagtacggcgcgctgccgatcgacccgtaccgacccggtctgtaccggatcgcggtgatcgcgatcgccgcggcggtggtgttctgctggttcgccctgctccgccgccggctgggcgcggccgcgctggccgtcgccgggctgggctggctggccggactgggcgtggtgctggccgcggtcaccccgggcggcgcctatctggccaccctgccggcgctggccggtgcgctcaccggactgctcaccccgcacgtccgaccgtgggccggcgccgcggtgagcactctgagcgggctggtcgccgtcgtcatcctgctgcccaccgtggtcatgctgttcccggcgctcggcatggcgatgggcgcggccggcgcgttcctgaccgtgctgatgctgctcgccctgctgccggtgatcgacctgatccacccgtcggcggagccggtccagggcctgccggccggccgggctcgccgccgcggcgcgctggccaccctggtcgcctcgctcaccgcgctcgcctgcacggcggccggcctggcggtcgaccggttcgacgccgcccacccgtcactcacccagctgatgtacgcgctggacaccgacaccggccgggcgcagtggctcagcgccgaggcgaagacccaggactggaccgcgcagtacgtgtcgggtgccccgaaagcggtggccaccacgctgcccgcgttcggcgccgaggaactgcggaccggcccggccccggcggccagcctgccggcgccggccctcaccgtggagtcggacaccccgtccccggacggtggccgggtcctcaagctgctcctgaaaccgcagcgcacggtccgtttcaccaccctgcacgtggccgcggcccatcaggtgacggcggcgaccgtcgccggtcagcaggtcccggtcggcagggcggcgggcggcggctggggcttcggcttcatcttccacgcgccaccggccgagggcgtcgaggtggtcctgaccgtgcgcggcaccggcccggtcaagctgcgcgccatggacgccagcgacaacgtcaccgagatgcccggcttccacgcccgcccgtccggcgtcggcgtcctcggctcgcacagcagcgagatggtggcggtcgccaagacctaccagttctgagacgcctcggctacctgccccggccgcggcggccggtcggggcgtcgtgccggaagtggatgaacaggcggccccagttgtcgccgtccttctcgacccggtggtagagctgcttgatctccttctggtcgaggaagcgcaggaccttcttcttcagcgctccggagcccttgcccggaatgatctcgacgagggccgccttcttctggatcgcctcgtcgacgatcccgcgcagagcccggtcgatctcgtgccccttgttgaagatgtcgtgcaggtcgagcttcagcttcatggcgacgaccttatgccggttcgttcttgccgagccaggtctccacccggcgcagcgcgtcctgataatccggctgctgcttcatcgcggccgccagccgcaggtgcggtagcgcctcacggaaacggccggcccgttccagggtccggccgagcacgtggtgcgcataatgatccgacggatcatgctcgatcagtgccctgagctgggtttccgcgccgttcaactgggccgagttgaagtatgcccgggccagcagctgacggaccgcggtgttctgcggctccgcctcgacgatcggttcgagcaggcgggacgcacccagcgggtcaccggactcgaagaagaaattggctctgcggtactcctcgagaagatccacgtgcagctccccacgctcgcgccgcccacaacgaccaacgcttgcacaacatcgagcggtcagcgagtgttccggcccggcaagcttcccggcaaaaacgcccaaagcccatcaaggtcgacggaaactgaccctaacgcgggaagcgtcgatgccgaagaccaagacgacaccatcatttccgtacgcggttccacagccgctacacaggaaacggaaagccggcgccgagcgtcgccgaccacagtgggggcatgacgatggcgaacgcagactccagcaccgaactccggcggcccgacggaaccccggtgcgggtcctcgtggtggacgacgagccgacgctggccgagctcctgtcgatggccctgcgctacgagggctgggaggtcaagagcgccgctgacgggctcagcgcggtgcggaccgcccgtgacttccggccggacgccgtcatcctggacatgatgctgcccgacatcgacggcctggaggtgctgcgccggctccggggcgagacccccgaggtgccggtgctgttcctgaccgccaaggactcggtcgaggaccggatcaccgggttgaccgcgggcggcgacgactacgtcaccaagccgttcagcctcgaagaggtggtggcccggctgcgcgggctgatgcgccggatggggcacgccccgatgcgcaccgagtcgcagctgatcgtcggcgacctgacgctggacgaggactcgcacgaggtgcgtcgcggcggtgccctgatcaccctgaccgccaccgagttcgagctgctgcgctatctgatgcgcaacccgcgccgggtgctgagcaagccgcagatcctggaccgggtctggaactacgacttcggcgggcaggcgaacgtcgtcgagctctacatctcgtacctgcggaagaagatcgacgccggccgcacgccgatgatccacaccatgcgcggcgccgggtacgtcctcaagccggccgactgacatggccgccgccgtcacggcccgcccccgcccagcccgctggcgcagcccggcgggctggccgctgcgtacccgcctggtcgccaccatgatcgccctgctcgcggtcctcggcctggtcgtcggcggcaccgccgagctctacgtctacaagacgctgcacgaccaggccgtcaaggatctccaggaggcgagcaaacggctcggcgtcggctttgactgccccgatccggccgatcccggccatgctggccagagatcgtgccctccgctgccctccggccccgacggcccgagccaggccggctccaaccccctcgccgaccgccgaatgttcaacggcatacagcgcgaccccatcgtgctctggatgttggccgacggaacgctgtccggcgggatcgtccacttcgccgacaacttcgggctgaaaaccgacccgctctccgccacggcgctggccaccgtgcataacaaggtcaccggcagccgcagcgtcgaggtgaacgtgggcagcgacctgccgcgttatctgatgacaaaacaaaccacgcgaagcggtgatcggacgtactacgtcggagtatcgctgaagaacatggatgccacgctgctcgcggtagccgggttcaccgggtgtgtggtgctcggggcgctgctcatcgcgggctgggccggggcgctgatcgtacgtcgtaccctccagcccctcgaccgagtggccgcgaccgcgagccgcgtcgcggaattgcgcctcgatcgcggcgcggtgcaactcgcgcagcgagtgcccgagtccgacaccgatccgcggaccgaggtcggccaggtcggcgccgccctgaaccggatgctcgaccacgtcggcagcgccctggaggcccggcacgcgagcgagatgcaggtgcgccagttcgtcgcggatgcgagtcacgagctgcgcaccccgctcgccgcgatccgcggttacgccgagctgacccggcgcagccgccagccgattcccgacgaggtggcgcacgtgctgggccgggtcgagtcggaggcgaagcggatgaccaccctggtcgaggatctgctgctgctggcccggctggacgccggccgcccgctggcgcaggatccggtcgatctgaccatgctggccgtggacgcgaccagtgacgcgcacgccgccggcccgcggcactactggcagctggacctgccggacgagccggtcacggtgatcggcgacggcgcacggctgcaccaggtgctggcgaatctgctggccaacgcccgtacgcacaccccggagggttcgaccgtcacggtgaaggtcgacacggtgccggacgccgccgtgctgcaggtgatcgacaacgggccggggatccaggccgagctggtgccgcacatcttcgagcggttcgcccgcggggacagctcccgttcgcgggcggccggcagcaccggtctcgggttgtcgatcgtgcacgccgtggtgacctcgcacggcggcaaggtcggtgtgcagagccgccccggccagacgatcttcacggtgatgctgccgtccgccccggcctcgccggtcgtcccatcagctgaacatcacacgccatatctgccgagggtcggctgatccggctatgctgtcggggtgactcagacgtctgcgttctattggtttacggggccggcccgcgccggtgcctcggccatgaccgcatgacctgagtcaccccgccagagccggctgaggcagcgacgatgtcgctgcctttttgtttgccccgagcaaaccggctctcgtccagggccggttaaaaggagagagatcaccatgaccgcccctgaggtgcagcgtgtccgcgaccagcgcatcgagaagatcgtcccgctgatgagcccggcgctgctgcaccacgagctgccgctgacgaccgagttgcacgacaccgtgctggccggccgcaagcaggtcgaggatgtgctgaacggccgagatcagcgcctgctggtcgtggtcgggccgtgttcggtgcacgacccggccgccgccggcgagtacgccgaccggctgcaggccgaggccgagcgcctgaaggacgacctgctgatcgtgatgcgggtgtacttcgagaagccgcgctccacggtcggctggaagggtctgatcatggatccggcgctggacggttccggcgacgtcggcgccggcctgcggatcgcccgcaagctgctcctggaggtggtcagccggggtcttccggtggccgtcgagttcctcgacccgatcaccccgcagtacatcgccgacaccgtggcttggggcgcgatcggggcccggaccgtcgagtcgcaggtgcaccggcagctgtcgtccggcctgtcgatgccgatcgggatgaagaaccgcccggacggcagcgtgtccaccgcggtggacgcgatccacgccgccgcggcccagcacgtgttcccggggatcgactactcgggcaccccggcgatcctgcacaccaccggcaacccggactgtcacctggtgctgcgcggtggcggcggcaagccgaactacagcgcgcaggacgtggaggcgtcgctggcgctgctgcgcaaggccggactgccggagcgcctggtgatcgactgttcgcacggcaacagcaacaaggaccacaaccggcagccgctggtggccgaggacatcgccgggcagatggaggcggggcagcacgcgatcagcggcgtgatgctggagagtttcctggtcccgggccggcaggagttgggcgccgagatgacgtacgggcagtcggtcaccgacgcgtgcatgggctgggacggcacggtggcggtgctggagcggctggccgcggcgtcggccaagcgccgcaccctctgaacggccgcgtcgtgggtcccgtcgatcgggcggcgggactcacagacagcgcacagggacggcacaaggacgcgacagcgccggtgtgaagagttcgtcgggtacgaatccgccagctctgggagtctcccgatgatcacgacgacgccggcacctgtcgaagccgccgcgcccgcacccccggacccgaacccccgatgggttcgtccggccgtcatcgcgttgctcgtcggcaccgcggtgctctacctctggggtctacgcgcctcgggctgggcgaacgcgttctactcggccgcggtccaggccggctcggccagctggaaggcctttttctacggctcgtcggacgcggccaactcgatcaccgtcgacaagacgcccgcttcactctggatcatggcgctttcggtacgggtgttcgggctgagctcgtggagcatcctggtgccgcaggccctgctgggggtggccggcaccggtctgctcttcgccaccgtccgccgcgcgttcggaccggtggccggcctgatcgccggagcggtcgccgcgctcaccccggtcgccgtgctgatgttccggttcaacaatccggacgcgctgctcgtgctgctgatggtcgccggggcgtacgccacgctgcgcgccgtcgagagcggctccaccaggtggatcgtgctggccggggtgttcgtcggcttcggtttcctcaccaagatgctgcaggccctgctcgtcgtcccggcgtacggcctggcatatctgatcgccggcccgccgaagctgctcaagcggatctggcagctgctgctctcgctcggcgcgctgatcgtctcggccggctggtacctcgccatcgtcgaactggtgccggccgccgaccgcccgttcatcggcggctcgcagaacaacagcctgctcgaactcaccctcggctacaacggcctgggccggctcaacggggcggagaccggcagcgtcggcggtgggggcaggggcggcaacggcggcagcatgtggggccaggccggctggacccggatgttcgacagcgcgcagggcggtcagatctcctggctgctgccggccgcgctgatcgtgctggccgccggcctggtgatcacgctgcgccggacccgggccgacctgcagcgcgccgggctgatcctgtggggctcgtggctgctgatcaccggactgatcttcagcttcatgcagggcatcttccacgcgtactacacggtggcgctggccccggcggtcggcgcggtggtcgcgatgggcgtgaccctgctctggcggcaccgggccaacctcgtcgcggcgctcaccctcggtgcggcgatcgcggtgaccgcctggtggtcgtggaagctgctcggccgcagcgccgacttcctgccctggcttcgcctgccggtcctgatcctgggcatcggcgcggcggtcgcggtggtcgccgccttccggctgccgcgccggatcgccctggtaggcgcggtggtcgcgctggtcacggccctggccgggccggcggcgtacgcggtgcagaccgcctcccaggcacacagcgggtcgatcccgtcggccgggccggcggtcgccggcggattcggtggtcccggcggcgggggccgcggcggcttcccgggcggcggtcgcgccggaaatccgcccggcggcttccccggcggcggcttccccggcggcggcttccccggcggcgggtctcccgggggcaacaaccaggcgggcggcggtacgacggatggtggcggccgcggtgggcgcgtgggcggcggcgggggcatgggtggtctgctcgacgcgacctcggtcagctccgagatgaaggcgctgctggaacaggacgcggacaggtacacgtgggtggccgcggcgatcggctcgcagaacgcctccggttatcagctcgccaccgagaagccggtgatggccgtcggcggcttcaacggcaccgacccctcccccaccctcgcccagttcaaggcgtacgtggcggccgggaggatccattacttcatcggcggccgcggcttcgacggcggcgggtcgggcagcagcgacagcagccggatcgccgagtgggtggcgtcgacgttcaccgcgaaaacggtcggcagcaccacggtgtacgacctcaccgtgacttcctgaccaccgtccacatccgaccggaaacgggcgacccctgcgggggtcgcccgtttttcgtgctcccggaagactcacagtgcggccacagttttctgacaaatcccgcaaagacgcgcgccggaaattgttcccatgagcctttcgacgctgccctcccaggacgccggttcggcccgcgtcaccgccccggtgctcgacgtggtcgtgccggtctacaacgaggaggtcgacctcgaaccctgtgtccggcggctgcacgcctacctcgcggcgcacttcccgtaccggttccggatcaccgtggccgacaacgccagcatcgacggcaccgcggccgtggcgcagcgactgaaggcggaattccccgaggtcgaggcggtgcacctgacccagaagggtcgcggtcgggcactcaaccacgtctggacgcactcggatgcggccgtgctcgcctacatggacgtcgacctgtcgaccgacctcggtgcgctgctgcccctggtggcgccgctcatctccggccactccgacctggcgatcggatcccggctggcccgcggctcgcgcgtggtccggggcgcgaaacgcgagttcatctcccgcagttacaacctcattctgcgtacgacgatggccgcccgtttctccgacgcgcaatgcggattcaaggcgatccgctccgacgtggcccggcgactgcttccgatggtggaggacaccggctggttcttcgacaccgagatgctcgtcctcgccgagcgttccgggctgcgcatccacgaggtgccggtcgactggatcgacgacccggacagccgggtcgacatcgtcgccaccgcgatcgccgacctgaaaggcatcgtccggatcacccgcgccctgagcaccggccgactcccggtcgcggcgctgcgcgaacagctgggccgcaacccgctgccggtcgacggcgtgcccaccggcctgaccggccagctgatccggttcgccgcggtcggggtggcgagcacgctggcctacctggcgctgtacgcgctgctgcgggtcggcgtcgggccgcaggccgccaacctgatcgccctgctggtcaccgcggtcgcgaacacggcggcgaaccgccggctgacgttcggggtgagcggcacggacggcgccctccgccaccaggcgcagggactggtcgtcttcgccgtcggcctcggcctgaccagcggctccctggccctgctggacgcggcggcggcgcagccgtcgcggttcgtcgagctgaccgtcctggtgctggcgaacctgatcgccacggcggttcgcttcctgatgctgcgcgtctgggtcttccgcacctcgcgagaccgcacctgaccgccgccctccgccattccccgctaccgcacctgacccgccccgccgttccccgctaccgcatccggccgccagcctccgccattccccgctaccgcacccggccgccagcctgcgccattccccgctaccgcacccggccatcaacccggccgaccgccgatcacctccgggccgcaaccagcggccggccgaacccgctccgcccactgtggttccggaactccgacgcggcgccccgcctgccgggcgccgcgtttccgtacccggcaggcggggtcgtttctatcgccatctgacctgatgagtccgaaatgcgagacagttttcgatcatcaagacgtcatcgaaacctggcaaagccgttgtaccggttaccgagcatctttccggtcatctcacccagtgggcgttcccgccggggccacaggttgttcggccgaaaaattcggcacacgcagacgtatcacggaagcaactcagaggtaacaatgggctttgatcgggatagccgactctcgatccttgcttcaccggcgcggcgaccggaaggtagcaaaacatgctcagcaaagaggacagccgacggctggcacagctggagcgtcagctccggcgcgacgaccctgacttctgcgcccggatgggcggcggcaatttcagcgtcccgaccccccgcccaccgttgaccctcttcttcgtcgccgccgcgatagccgtcgccgcgatcgtcctgggcatcctcggctggtggatcgccgccacactcgtcgccacctggggcctagccaccgcagccgccgccacctaccgcctgcgccggttccgcacccgcaccccatagcggtccgctctccccgacagacccccgatcgagacggctcgctcgccaccccggcccctgacggaattccccgatcggcccggctcccagccccggccctcagccccggccccggcccggccccggcccccggcccccggccccgagagatttccccgatccggacggcccgcaccgacccccgactgaccccctccgatcgagcccgcgcccggcacggcgcgggctcggtcacatccaccgccgcgcatccccgcggagagcgttcagcgaccgcgaacagcggcgacaaccgccgcccgagggctggagagcaccgaacggccgggcagaaggtcagcggccggtgccatgctcggctgcgccagaacgaccacgtcggcctcgacatcccgcagctggtcagcgatgccccggtagtaggccggcagatcaccggattcgaagtactcccaggccgccagacagggaaccagcagcagatcggccgcggggtccgcgtcgagcagtagtgcggtggtcggttcccgggtggactcgacggcgtaggcgaccgctatccggcctccgacggcaaccgccgcctgggccatcgggcggtccccgcgcagtacgccggcccgttccgcttccgggccgatggtcgagcaggtgcagacgatcacgtcgcagcccgccaactcggccaaccgcgcccgcaccccctcctccacggggagtccagcccgcgcatcggccaggagacccggatccaccacatgccgatcacgccatcccggcgccacctcgcccaccagcgcccggaacgtcgccacatgcacgtccgctgtatgcagaaacccgatcgtgcccaccgcccacctccccgcccacccggcaaccagagatcatcccgcaccgggcgggctgcccggaaccaccacgcacccacccggccgcgaaaccgctcatgcccccgccacaggacacccgggacagccacacacccacccggccgcaaaccgacatgcccgcgccacacgacagccgggacagccacacacccacccggccgcgaacccttcgaccatgccgtcgcgcggccgcgaagccggatcgtggccggcacgttcccgtcagtcgaaggcggtggtcgccgacgggacgtcgcgggcgcgtgccacttcggccgcctccccctcgatccgctcgcgctgggtggcagtcaacggccggaacgggctgacggtgagatcgacgcgtctccggccggacatccgcggtcgccacaccccggcgatctcgccatccagcaacagcacgcccgggttgcccagcgcccgccacacctccttctgccgctcccggtcgggcaccagcagatcccggtcacgggcctgcagcagcggatccatcgccggcagcagccgcaccccggccggtgtcgggggcgaccccagcgccggcacgtcaacctcgggaagccaggcccggcgcccggcgacgtcgacctcgaccaggccgtccggccagaccgagcggatctcctcggtcgtagtcgacaggtatctcgccacctcggacgggcccgccgggccgagaaaccgcagataagtcgtgatcagcgcgccgatcccgcgaccggcatcagaagccgggagcgccgcgccaggcagcgcgccggctccccggccggcatcggagagcgcaaggccggcgccggccagcggcaaagcaacgtcgggcagcggaaggccggcgtcggaaagcggaagacccgcaccggacagcggaagacccgcgtccgacagcggaagacccgcgtcgggcagcgggccgagcatggcgtctctgccgcgggagagcacctgcaccccgccggcaagcccgctctgctgccacacgttgcccgagatgtgccgggcccggcaggtcttgcactcgaaggtcagctccgccggcacccgggcgctgacccgggtgctggcctcaccccgcggcatcggggcgcggacgacctcgcgcatcgccgccgcggtgacccggaaggcctcgatgccgaggcgggcggcggccgggatctggttgctgttgatccgggcggccgcgtcggcgtggctgagcggccagagctgcgcggtcagccggggcaggtcgacggcccggtgcaggtgcggggcgccgcgcgcggcccagacggtgagcagccgatcgtcgtcgagggcgacccgggtgcgcgcggccagtgccacccgggtggagccgggggtgtaatcctgcactcccaggtcgaggacgggcaggtcggcgggccggatggcaccgcgggcggacagccccagcgcggcgaggcggtaggccatcacctgcgcgcgatccaccttgagcatcgagcacaccccgttcgttcaggtgcgacgaccgtaccgccgggatgcgacatttctcaggccctcgcggcgggtgccgggcagcccgcggacgtattcccaggtgtccaggctcgtcggcccgtacggcccctcctgcgggatgggtggctcgccggtcagccggtagccgcagcgccgggcgaccgcggtgctcgcggtgttgtccgggtcgatccgcagcagcagcctgttcagccgcagcgtcccgcaggcgtagtcggtgagcagggacagggcggcggcggccagcccgcgccggcggaagcgggcgccgaccaggtagccgagttcagcttcgcgcagggccgggtcgacgccgaagagcagcacctcgccgaggggtggcccaccgtccgcggtgatcgcgagctggatccgtcggccggtcagccgtccctgccgggcgcgtttcaggtatgcgatgccggcgtcgacgtcgaacggggacggcatcggcgtccatcgggcgatgtccggctcgtcgagcaacccgaccaggtcggccaggtcgtcgggactccattcgcgcagcacgatgccgttgcccgccaacgtcagcgggtgcggcagcggactggcggtcacacttcgaatcctgcccataagggcccgtttgcggctagggcgatcagcgtcggattaccgatcgcgtccggcggcccggcaggatgcagggcatgcctgatccggtgaacacccctgagcattggacggaatacaacgcccaccagggtgaccgggcggtccgggacacctgccggatcgccatggacctggccggtccgggcgccggccgcaccgccgtcgatctgggctgcggggccggcatcgagacgcgcgcactgctcgacgccgggtggcgggtcagcgcctacgacagcgagccggccatgctggccggcctcgaccatccgtggctgaccgcgcaccggctccgcttcgaggcgatcggggcgctgccgccggccgacctggtctacgccggttatgcgctgccctggcagacccgcgggtccttcgatcgcttgtggacgctgatccggacggcggtgcgcccgggcggccggatcgccgtcgacctcttcggtgtccgggatgcctggtccggcaacccggcgatgaccttcctgaccgccgccgaggcccgctcgctcgccgacggcctggtcatcgaccactggcacgaacaggacgagaccgcgccggcctaccgcggcccgaagcactggcacgttttcaccctggtcgcccaccggccggagaactgaccggcgggcggtcagagcttgtaagcggtgatctccatcccggccgcccgcagccgcgccaccagcgcatccccgataccggtggcgggcgtcagcaccccgccctcgctctccggcagtgcatcccggtccagggcgagcgccagcgccgactcgcccagcatcacggctgtcgccgcatatccggggtcgcccttggcccggacccgcgcccggtaccgcgccccggtcgtcgtggtcgtgaagatgtccatggtgaagtgcccgtcctgctgcgtcttctcgcccggcccgtcgccgggtttgggcaggatccggtcgagcaggtatcgcgtgggcggcaccgcgagcccgacgatcagcgcgcccaggccgagcttgatgccggccgccaggaccggggagagcggcgacgccccgacgctcatcgcttcgcgatatttgaaggcgcggccgtacgcccaaccccgcaacgcgttgctccgtcgcaccacccgggtgttgtaggaggccatcacgaagggtgccagccgcccgcggagtttcgggtccacttcggaggccgggatggtgtccatgtcactctgccggcccagtttgggctcggcctgccggtcggggctgagcgagtacgggctgccggcgacgcgccgcagtgacggatcctttttcatcacgtcgacctggttgcgcatcgaatcgatggtgccgccgctgaccccgccgtgcatgctggtgacgaccagtgtggtgtcggttagttcgccggcgccgtccgcgacgacctgctggtgcaggacgtgcacgccgatgtcggacggaatggagtcgaagccgcaggagtgcacgatccgcgcaccggtgccgcgggcgagttcgtggttctcgtcgatgctgtcgcgggcgaacagcacctcaccggtcaggtcgacgtagtcggtacccgccgcggcgcaggcgtgcgcgagagcccggccgtacttcgcatacgggccgacggtggtgatgatgacgtgggcccggccggccagggtggccatcgcgtcggggtcgccggcgtcggccaccacgatcggccagtcgacgccgagcctggttttcaccgcttccagcttcgccggtgagcgcccggccagcgcgatccgggtgccggccggtgcgtgcccggcgaggtgacgcgccaccagcgcgccgacgaatccggtcgcaccgtagacgatgacctcgtagtcgcgtgaacgatcgctcatggtcggagattgtgcaccccgggccgggcggtgggtacacccgccggtaacaaagcccggaaaaccgtggctggcagccgaaatcagcgtcagcggattctctttacccactgcggaccgggctctaaccatgacttcggactttcccccgtccggctgaccacgatggcggcaagtcgtgacgcgatcgaaaaactcgtggagttatccacacaaaggaagatcaaagcggctaatttgggtgaacaacgtcaccggctgtgcttacaggcctggtcattcctgtaaggcggtgactaccgtcggcaagtccgcaccatcgcggacaccgtgactggaacgccgagtcctgcctgccggtcacggtcaacaacccacaggcatggagcgggggacccaccagttcctcggcacgtccacgagccggagttcccggaacgcatggacgagcctcggggtgaagccgcacccgtgcggccgggctcctcggcccgaacccgacagctcacctcgcaggcgtggagggaaaacttcatgcttcacctgaaccagcgggttcgtcgtgtcctgtcccggcgagcccagtccccgcgtgccctgaaccggctcgcgcaggctccggccaccgccggactcgtcacggagagcaccgcaggacccggaaggcaccggcgcaccgaggtgcggcgggccagaatccatctcatcgcactcccgaacgcccgccccggtttcaagcgggctctcggcatcgccatcgccggcctggccggcacggtcggactgctcgccaccggggcctccccggccagcgcagccgccgcggacgtcaactgggacgcggtcgccaagtgcgagtcgagcggcaactggggcatcaacaccgggaacggctattacggcggcctgcagttcagccgcagcacctggcgggcacacggcggcacccggtacggctccaccgcgaacctcgcctccaagagtgagcagatcctgatcgccgagcgggtgctgcgccaccagggcatcggcgcctggcccacctgcggtcgccgcggcctcaccagggcacaccggacgacctcggtgagcccgtaccgcctggcgtcctacacaacgccgctgcgggcgagccacacctacgtggtgaggcgcggggacaccctgtcccggatcgcgagccgttaccacgtcaggggcggctggcgcgccctttaccgcaccaatgcgaagcggctgagcagcccgaaccgcctgtcggtggggcagcgcctggccatctaggcctgctggccgggccgcatctccgggtggtcgaggacccgcagccacgagccgtcggcctgacggcggaccacctgtgccctcgccccggcgccgtctttcggcggggtcgcggtgagggccaggtcgccgctgatcagcgtgggcagcggcggctccggctcgaaccgcggcatcttgggcaacagctccgcccacagcttctggatggcggcgcgcccgaccgtctggctgccgggcggataggccatcaccgcgtcctcctcgtagagcagggcgaggccctcggcatccttcgcgttggcccgctcgacgaagagccgggtgaggtcctcgggctggaaggctttctcggaagaagtcatgtcttcaccctcctccgcgccggtccacaagtccaacgcatagttttgatggcagctacaatcgccactcatggatctgcgtcagctggagtacttcgtcgcggtcgccgagaccggcagcttcacccgcgccgcccagcgggtgcacatcacgcaatccggggtcagcgcccagatcaaggccctggagcacgagctcggcgccgagctgttcatccgcagcggccgcaccgcccggctcaccgacgccggctcggtggcgctgcgccacgcccgcgccgccctcgactccacgctcgacctgcgcgacgcgatcgacgaggtcaagggcctcatccggggccggctgacgatcggcatggtgatcggctgcgaggtggcgccgctgttcgacgcgctcgccgccttccatgccgagcaccccggcatcgagctggagctggccgaggccaactcggatcagttggtcgccggcgtccgcacgggcagtctggacgtggcgctggccgggctggccggcgttccgcccgagcatctggccacccgggtgctgatccgggaacggctcgtggccctggtgccacccaccagcgacctcgccgggagcccgggcgtgccgatcagcctgctgtcggcgtaccccgtgatctgcctcccggtggggaccggcatccgtgacgcgctggaccgcagcaccccggggcggtcggcggtcgcgctcgtcgcgacctcgccggacacggtcgccggtctgacccggcgcgggctgggtgtcgcggtgctcagcgagtcgatggcggccgcgcacccggatctgaccgccgtcccgatcgacggcgccgacgtcccggcgctgctcgcgctggtctggcaggagcgaccgaatccggcgctcaccgcgttcctgaagcatttcccctaggaagaggcccccgtcgcgatcgcgacgggggcctccgcagaaaccggattacctggtcagcttctggttcacgacgtaaccgggcgaggtgttacccgccctgtccaccgcgctgtagctgatccgcagcgtgccggtggccaccccgtgcacccgcacggaccacaggttgccgctgacggcggcggtgagcaggtcggcccgggagatggccgtctccttggacgccgacttccaccaggcgccggcgtggtagtagtaccacttgccgtcgacccggtactcgaccgccttgacccggacgctcgcgacgccgagcccctggtcggtgaccgtgccgtgcaggttcgtccacttctcggcgacgttcgccgggttcggcaccagcaggctgggcgccggggcgaagacgtcgtcggccaccgtgacgacaccggcctggatggcggcgccggcaccgagcttgttcaccggcgtcaccgtgaccgtgtatttaccggccttggtgtacgcgtgcgccaccgcgatgtcggccgaggccgagccggtggtcccgtcgccccaaccgatgttgaccgagtcggcggtgacgacactgccggtcagggtgaccgcctgggtcgtccagatcgaggcgcggtccagcttgaactggccggcctgcgcggcgaccgtgaccgtgccgccggcgacggtggccgcgttgccggcctcgtcggtgatcgtgacctggatggtgaagctgcccgccgtcgcgtacttgtgcgtggcggacttggcgccggcctccagggtctcggcggcgctgccgtcaccccagttgaccacctgcttgatcttcgcggcggcggacttgtcgtcggccagcgaggactgggtcagggtgaccgtctgcccggtccagatcgcggccgcgttcaccgcgtacgccccggtcggcgccgtgccgtcggtgaacttcaccgaccgcggggtcgggtccgggctgaccggcgagtgctgggcgaagtagttgaccagcatggtcaggtcgttgtcgccggtggtggtccgactcgggttgttctcgcccagcacggtgaagttgtcgccaccggaggccaggaacgagttcatcgtcacccggtacgagccggccgggtcgatggtgaccccgttcagcttcatcgacgaggcgatgatccgcgaacccttcggcagggtcgggtcgtactggtaggtgaagcccttcgagacgcccagccagaggaccggacgcgacgcggtgtccggctgccactgctgctccagcgccgtcttgagctgcgcgccggtcagcgtcttggtgaccacgtcgttcgcgaacggctgcaccgcgtacgcctgggcgtaggtgaccgtgccgtccgcgccgtacagcaggtcgttgcggagcccgcccgggttcatcacggcgatctgcgcgccgccgcgaccggcgtccctggtctggtcgagctgcacgtcggcgatgagcttgcccatgtccgactcggcgccgcggtcctcggacccggtgctggagaccgcccgcttgatgtcgccggtgatcttgccgagcaccttcttgccgagctccgcggagttggccttggccgccgtcacgatcgcggcgacgtccgcgttctccgggtagccggtgaccggcagcagctcggcggtcgacgcggtgaccgacctggtgaccgggtcgtaggtcagcttcgcccggcccagcttgacgccgtagtcctcggcctggatcaccggacgcagccggtcggtgcccgggatcgggatctcgaacgcgtacggctggtgggtgtgaccgctgaagatcacgtcgatgtccgggccggccttggtgaacgggccgaagaccgggtcgttctgcagggcctcggcgctggagatgttcgcggtcgcggcgccctcgtgggtgagcagcacgaccacgtcggcctccccgttggcctcgttgccgtcggagagctcggccgcgacctggttcgcctcggcgaccgggtcgtggaactccacgcccttgatgccgtccgggctgaccagcgacttggtctcgccggtgaccacaccgatgtagccgacccggaccccgcccacggtctgcaccgagtaggccgggagcgcgcgcttgccgtcgacgtagacgttcgcgcccaggtacgggaacttggcccggctctgcacgtgcccggtcaggtcggcgatgcccttgtcgaactcgtggttgccgaccgcggaggcggccaggccaccggtgctcagcgcgtccagggtcgggttgtcgccgtcgatcgacgagacgaacgtcgaggcgccgatgttgtcaccggccgacgtccacagcgtgttcgggttgtccttgcgcagcttgtcgaccatgccgaccagctgggccgcgccaccgacgcccgccgacggggcctcgatgcgcccgtggaagtcgttgatggtgagcagctgcaggtcgatcggcttcggcgcgctggtgtccaggccgatcacgaccgggtcgtggtcgctggcccggtacgggtcggggctgtagaacggcgcgtacccgttgtactggaagccgtacgactcgaccgagttgatgttccagatgtcgacgccggtgacccggtcggtcagcgacggcgtggtcagcgcgtggtcgagggagccggactcgccgccgaagacgtacgagttcttccccggcgccttggcgctgtgcacgtcggtgtaccccgcgctgtagaggacctgcatcgggtcctcctgggtgtacgagttgaagtcgcccagcaggatcaccttgtcggtgccgctgtccttctccacacccttgacgaagttgacgaccgcggccgcctgacgcttgcggtccccgttgtacgggccctgcccgtcgccggcgtccacgttgtcgccggtcggcggcaccccggtgctcttcgacttgaggtggttggccaccacggtgaagtcgatgctgccggcgtggaaggtctgcgcgatcggctcccgcgcgttcgaccacacgctctcgtcgttcaccgaccgggacgcgcccttcggcgtgaccttggccggcttgaagatgatcgccgtggtgatgacgtcctgcgactcggggcccggcagctcggccggcgtgcgcacgtagtcccaggtgcccgcgccgtccttctcgttcagcgcgccgaccagggtcttcagcgccagctgcgggtcgttcgcgtcgaacttgaccgagttctcgatctccatcagcgcgaccacgtcggcgtccagcgagctgatcgccgagacgatcttcgcctgctgcttggccagctgcgcggcgtcggtggcgccgcgcgcgtcgccaccgaagtggacgaagtagttcagcacgttgaagctggccaccttgatgtcaccgcccacggccgccggcttggcggtccgcgggttgctgtcgtcgaaggtggtccggctcgcggccggggtgtccgcggacaccggggtggtcggctccagcagccagtcaccgtaggcgtagtcgagcaccaccggaccgaacgaggcgaccttgtcgccggcccggatcggctgctccttgctgatgtacggcggggcgatcccgttcgccgacaggttggtggtcttgccgtcgtccagcaggatccggcggtcccggttctccgccttgaccgccgcggcctcggcgctgcccgccttcgccacgtcggtcggcaccttggcgaccttgtcgccggcggccagcacgacctcgccgtaggtggtcaggtagtacgggtccgaggcggtgtagtcaccgaccggcgcgaccagcatgccctcgaccgactcgcggaccgcgtcgccggccggcagcttcagcggcaccgcggtcggcagggtcgcgtcggtggcgcagacctggacgtcggacttcgcggtgtacgacagctcggtgagcgagttgaactcggtgaccgtgccggtcacccggacctgctcgccgatcttgatgtccgcggtgccgccgtgcacgaagacggcgtccgacgcggcacccgcggcgaccgggcgatcggcgccgccgctgcccgcggtctgcaggtagaagccggcgaagccaccggtgcggtggtcggcggtgaccacgccctcgacggtgaccttctgcccggccagcggggacgccgcgccggtgccctgcacctcggcgatggtgttggtgaccgcggtggtgcaaccggccggagccgggtccgggtcggtgccaccggctttgttgagggcgccgaacgtgttcgcggccgggccggtccacttgccgtcgatcttctgcagcgactgcccgaccggggtgctggtggtctccgcgaccccgatgtcggtgctggtcaggccggtggccgggccgtcgaccgggaccagcgtgccctcatagctcagaaactcgacgaccgtgccgtccggcttgaccagggcgacaccgtcgtccggtccattctcgacgccattcgccgggtaggtctgcacgaccacacccgccgccggaacggccccggacaacgtcttggtgtcgtacgacgtgttggtgtgcccgttgtagaggacgatctgccagccgctcaggtcgaacccgaccggcgcctcgatctcgaccgcctcacccgagtcggagccggcgttgtcgtagtggatctcgctgatgaaggggatctgggcttcggccgcgaacgccggcccggagaaaccaaaacccagcgcggtcgcgagggccgcggcgcccaaggctcggatcgcctgcgggctcgcagcggcactcacgctgcgtagatatggacgcatggaaacaggtctccctatggaagtgagtgcgccgcagattagggaggcttggtgacggaattctctcagccaggtaacagaaaggggttcaccccacaaaggacgtgggtgaatccgcccttaacgaccactcaacccgacggcggcccgctccgcgtctgtccactacggaatgttacctgtcggctgtctatacagcgagtgacggtacgttcccgtcccgacgctcgaacccgcaaaacctcaatccctccattgcggcggtacgccgtgagcaccccgtcccgggtcgccgcatccgagccgggtgggcgccgaacgtgatctaggtagggctgaaaggatgagtttcggttttatgcgggtttggtgctttctgtcatggttattgaagttcggggggaaaagacagaagggaagatcatgcggaacaccatgcgtgtgctcggcctcgccggcctgggagtgctgggcggcgccgtgctggcgaccgggccggccgccgcggcgcccagcactgcggcgaccggacactcccaggcgccggccaaggcgcagcgggacccgtggaacgacgacgaggtcgtggggtactaccggaccttctgggcgtgcgagcgggccggacaggtcggcgagcggttccgggcctgggacgaccacgcctgcgagcgggtgcggtggggggtccggcgcggagcgttcgcgctggtcgtcgaccagaacgactgggaccagcggtgggacagccggtggcggccgggaatctggccgagcaactggccgaaccggccgaactggcccgggcacggccggccggaccacgacggtccgggcggacacgacggtcccggcggacacgagggtccgggcggccccggcggacatgggggccccggcggacacgagggtccgggcggacacgacggtccgggtgcgggcggtcccggtgggcacgggggtctagctagctagggtgcgggcggtcccggcgcgggcggcccgggtgcgggcggcccgcactcgaatcactgatcgcggttagccagcgaaacagccgtgggcgggcctgacggcccgcccacgacaatctcagttcaccaccggttccccgggcaccgtgaacaacggcgcccatgcctcatccgggtcgaccgggtagtcggtcgacggtgcgtcgccccgggtggtccaccgggcctcgtacggcaaatcgttgtaagtgactcgatctccgcgatggtaggacgtgccgggattccacacgttcgtcacgccggtcacgttcggcgtcggcgtcggccgcttgtcgcccgtggtcaccggccccaccaccgaccacgggttcggcgcccccgccgtgtcgtccgccgacggatcggctcccgagttggcccacttcgcctggtagacgacgccgtgccagaccaccttgtagccgcccacgtactgcgcggtcagccgccacaccgggtacgggctggtcgtcgggtcgtcgatggccgacgaccggttggggatctccaccgcgtcccggccggatgatccgaccgaggtgccgggcagcccggcgaacaccttggagaaggccagcgcctgctggtcgacaccgctgcaggtgttggagtgcaccaccacgttggtgaaggtgcccttgcaccgtgcgtcccggttcagcgaccacatggatacccggccgaggcccttgtcgaccgcgaacgtggcgagtccctgggcatcggcgacggtgaaccgttcggtgtcgacgtcgttctgcccgatcatcggggtggcgccgatccgcgaccacacctgtgccgaggtgagttgcgcgccgagtcgcaggtacaggtcggtgagctgcttgtgggtgttgtcgagggcctgcgtggtgagaccgagcatgtccgggttcgcgctgttcccggtcccgtagtccatggtcatcacgttgacaccgcgcagtgcgacgccgccgtcgagggtggcgcggaccgcggcgagcccgtcggcggtcaggccggacggggagaccggcacggtgagccacacggcgagcgggtcaccggcggctttgcgctcgtcctgcaccgtcttcagcgccgcggcgcggcgcttcagcgacgcctggtcgcccagggcggcgccttccacatccaggtcgagggtggccaactggtagcgcttcaccaattggcggtacgcctcggtgagccgcgcctggtcggcgcacgccaccgcgagttcggtgttgctctggccgccgacgctcaccatgatgttgccgccggccgcgcgcagctggctgatccgccggtcgagttccagggaggcggccgcctcgtcgagcgtgtacgccccgccccagctcggcacgcagccgtcggtccggtcggcgaccacgaagccgagggccacgtcgttcgccgggttggcgtccggatcctggaattcgaaggtcggcgtgagggtcacgtcgacgtacggcaccgcccacgacttggcccgggtgccggcgttctccctgaggcgcatcgcgccgaaggtgctgccggcgccgaccgcgccgagcgccaggatcaggaagagcaaccggaaccaggacagtctctcgccgggctgctcgggttcctgccagttcggatcggccagcggatcgtcgtccggccgcactgtctgcggggtggcgcggtcggtgagcatcggggccctctcgttcatgggtgtctgggcagtcacatcggcgccgcggcggcggactgaaggacccacgaggttttccggtcaaaccttcatgcggtgtcctgccagcgccgatggggtgtcgaacggtcccagtgccgaggccggattcgacaacccatgaagggcaaccccatgcagcgcacctcggtggcccagccccggccggacgcccagcgccagtggggcgccgaccggcggtcggccccccatccggtggttccgccacccatttccgaggggcggatcgcccgcggccggctcgcgatcgtgctcaccatcgcggtctgggccggctatctcgcctacacgattttcgagcagttcatcgtcggccgggcgagcaccgcgcggctggcggtcgaggcgatcgtctacatgctggtgatcaccggtctcgccgcctcggcgatggcgtacctgatcacccggatcggcttcttctaccgcagtcgcgggcatcagcggtcgccgcggatcgtgctggacgcgttcctggccgagccgaagacgccgacggtcaccgtgctggtgccgtcgtaccaggaggacgagcgggtcgtccggaccacgctgctctccgccgcactgcaggagtacccgggtctgcgggtggtgctgctgatcgacgacccgcagcagccgaagacccggtcggcccgggatctgctgctgtccgcccggcggctgcccggcgcgatcgaggcggagctcgcggtgccgttcaaccgggcgcaggccgcgttcgagcagttcgagcaggcgctcgcggatcgcggccaacgggtcgggaccagcgacgacatgcgggcgctggccgccgagtaccgggccgcgaccggctggctgtacgggctggcgaaccggcaggagatggtcgaccacaccgacacgttcttcgtcgaccacatcctgaacgcgctggccgaggagttgtcgacgatcgccgaggcgctggagaccggcgccgaggagaacgccaccctgccggtggcccggttggtgcagctgtacagccggctgctggcgatcttcggcgtgtcgatgacgagcttcgagcgcaagcggtacgtgtcgctgtccggcgagccgaacaaggcgatgaacctgaacagctacatcggcctgatgggcggcagctaccaggaggtgcgtacgccgatggggctggcgctggtgccggccggaccgggtcgcgcccagttgaccgtgccgaatccggattatgtgctgaccctggacgcggacagtgtgctgctgccggattatgcgctgcgtctggtacacatgatggagcagggcgcgtcggcaggggtggcggtggcgcagacgccgtacagcgccttccccggggcggcgacccgggtggaacggatctccggggccaccaccgacattcagcacatcgtgcaccagggcatgacgcagtacgacgcgacgttctgggtgggggccaacgccgtactccgcaagaaggctctcgatgacatctgcgagacggcctacgagggcgattgggagatcaagcgctacatccaggaccgcacggtcatcgaggacaccgagtcgaccatcgacctcggggtgcacggctggacgttgtacaactacccggagcggctcgcgtacagcgcgacgccgccggatttcgggtcgctctgcattcagcggcagcgctgggccaatggcggcctgctgatcctgtcccggctgaaggaccagttcaaggcccgcaacaagcgggagcagaagaaccggttcggcgagctgttcctgcgggtgaactacatggcctccattttctggagttccgtgtgcctggtcgtgatgctggtctacccgttcaacaaggatctgctcaacccggtgctgctgctggtgtcggtgccgtatttcatgatgatggccggcgacctgaaggcgaacggctacaagcggctcgacgtgctgcgcatctacggcttcaacctgatcctgctgccggtgaacctgtccggtagcttcgcctcgctgctgcagttgctgaccggcgagaagagccagttcaaacggacgccgaaggtccgcaaccggaccaccgcggcgacgttctacctgctggcgccgctggccctgatcgcgctctgcgggtataccgtggtgcacgacgtccagcacaagctctggaacaacctggccttcgccggtttcaatctccttctctcgctgtacgcgatgatcgcgttcgtcggtctcggcaacaccctgatcgacctgttcgcccatctgcgtgcctggctgtaccgcccggtgaagccgaagaacaaggccacgggcacgccggtcagctcggttccggcccccgccgcgctcggcggcggcgcgatcggcgactgggcgtcggtgctgcactacggcggcgccgagcggggcggttccggaatggtcgcggtccggtccagccaggcgccggtcacccggggccgcaaggccagcgtgtcgcactcgttcgaggagttcaacttcttcaccgtgttccagccgatcttcgagctggagtccggcgacgtcgtcggctacgaggcgctgacccggttcgccgacggcagcaccccgcagctgagcctggccgcggcacaggaccagggcctgcacatcgacctggacgcggcactgatccgggccgcgctggcctcggcgaattcgctgccggccggcgcctggctggccgtcaacgtctcgaacgacctgttgcgccggccgcacgagctggcgccgctgctggacgaggcgaaccggccgctggtcctggagttccgcagcccggaggccggtgacctggagcggctgccggccggggcccggttcgcggtggacgacgcgggcgccgggttcgacacgctgtcccggatggagacgttacgaccggagatcctcaagctcggcccggccacgctggccggtatcgagacgtcggcggcccggcaggcggcgatccgcacgctggtggagttcgccgaggcgaacgactgcacggtgatcgccgagggcatcgagtcggccccgcagcgcgatgccctgcgggcctgcggcatccgcctggggcagggcttctacctgggcaagccggtgccggtggagcgggctctggcggacgccaccagccgctaggttggagatgggggccgcgatccaggttttctgggtcgcggcctccgtgatgtagcccactctcttgcttgttgaagtttcaagagcaaccggcgaatagtgttggtgaaacttcaacaacctatgggggttgcgatgacagtgacgatcggacaggcggcgcaggtccgcacccgggtcaccgtgccgctggagttcccggacggctacgcgaccaccgcggaggtgttcaccttcaccggcctcgccgacggccgtgagcacctcgccctcggcctcggcgactggcggaacgcgacgaacccgctggtccgcccgcacagcgagtgcctcaccggcgatgtcttcggcagccagcgctgcgactgcggcccgcaactgcgggaggccgccgagcggatcaccgaggccggcggcatcctgctctacctgcgccaggagggtcgcggcatcggcctgtacgcgaaactcgacgcgtacgcgctgcaggacaccggcctcgacacctaccaggcgaacctggccctcggccacggtgaggacgagcgggactacacccccgccgcccagatgctgcacgccctgggcgccgaacggatccggctgctcagcaacaacccggacaaggccggccagctcgccgccctcggggtcgaggtgaccgagcagctgcctacgggcgtgcacctgtccccggcgaacgcccggtacctcgccgccaagcgggaccacaccgcgcacaccctcgacctgaccggtgccgcatgacgcttcgcgacgcgaccgaggccgacctcttctggacccggtcggccatcgacctctcccggctctccccgccgtcgccgacccactacgcggtcggcgcggtcgtggtcggcccggccggcaacccgatggccaccggctacaccggcgagaccgacccgcacttccacgccgaggaggaggcgctggccaaactggccggccgcggcttcgacctgggcgccgccaccctctacacctcgctggagccgtgcaccgtccgcaagtcccggccggtctcctgcaccgagctgatcctggcgagcggcatccgccgggtcgtgctggcgctgcgcgaaccgctgcacttcgccgactgcaccggggtcgagacgctgctcggtcacggcgtgcaggtggtcgagatcgccgcgctgggcgaggcggtacgcgatatcaacgcccacgtcatggggatgcagacgacatgacccaggatgccctcgcgaccgacacccgctggctcagcagccccgagatggccgcctggctcaacctcacccagctgctgatgctgctgcccagcgccctcgaccggcagctgcgcgacgacgcgggcatcccccacgcgtactaccagatcctggcgaacctcagcgccgcccccggccaccagatgcggatgaccgatctggcccgcatggtcggcaccaccaccagccgcctctcacacgcggtcaccagcctggaacagcgcggctggctgtgccgccgcgcctgcccgttcgacaagcgcggccagatcgcggcgctgaccgaggccggcatggcggtgctggaggcggcggctccgggccacgtcgccgaggtccgtcgtctgatcttcgaccacctctcggcgaccgaggtcgatcagctccgcgagatcaccggaaagatcctcccggccgccaccgcctgaccgctgcgaccggcgtcacgccgccgacacccggccggctgccggcatccgccaccagcttgacccccggcaccgcccgccccctgccgccgatgccggcggccagcgggacgcttcccaccgaccttcccttcccggtcgtcgcatgcgccgcagggggatgccgtcgaccagtggcaagcaaggccttcttcaaggctcctctttctccccgttctcgccccggtcgccgcgacggagacgagtcggcccggcgcacctcccgaccgggtggatgcccggggcgaggtcgccccgggcatccacgggtcagtcggtgaccgtgccgtcgatcacgccgagcgggatcgggtcgccgaagtcggacgggtagacctgcgtcttgaagcggacgtgctcggcgccctcggccaccccgtcggcgaccgtcgggaccgtcaccgcgagcgacgtggtccccggttcgatcgccacgaacagctgcaggccggcgccggacagcggccgggacggcttcgggtcctcaccggtctggtcggtgaaccagcgggcgtcgacgtcggtcgacgacagctccggcccggccggcggagcctgcgtcacgaactccacgtacaccggaccgccggcgaccgtcgacaggtgcaccgtccaggtcagcggcgagccctcggtcgcggtggccacggccggcgtgatggtgaccttgggcatcgggtcgtcctcgcgcacccggaccccaccggagtagtcgccgaccacggcgttccggacggccttggcggtcagcgggtacgaccggtccccggtgtacacggtgtcaccggtgaccttgatcggcaccgagatccgggtgtcgccgggcttgacccgggccacccacgacttggtctccgacgtgccggggtcggtcaggaacagccggacgtcggccgcctgccggccgcgcacccgcaccggcacgctgtgcgtgcgggtgccggagtcgccctcggcgacggtcaggtcgccgacgtcgatccggtcgagcgcggccggtcgcggggcgggggtgccgggctgccagccccaggcgtcgatcagccacgccgggcggttgccacgcgcggtgatctccacccgggccaccgtgccgaccgtccgcgggagcggcagccgcacctcctgggcccagtacgacgtggtcacgccggtgccgggcatgccggtgaccgtggccgggccgaggtcggtgcgccggccgtggtcgtcggtgaccgcgacggcgaacgaggtggccggcgcgttcggcggcacgatcagccgcagggccagggcctgcgaaccggccaccggcatcggcttggccggctgcaacgtggcggtcccggtgccgttgagcgcgaccgcgacccggccgggttccgggacggcgaacggcacgaagtgcggcgaggcaccggcgatcgtgtcggtgtccaggcagcccttggcggcgtcggtggcgacctcgtcgcacagccgggcgccgcggacggtgagcgccgcgtccggaacgatcaccgggcggcggttgccgccgagcgcgtggctcagcacccgggccgggccggccgagcgggcgcgcaccccggagccgtcgagcagcgggcgggcccggtcgtcgccgccgaggaacacccgggcggcggtcgcgatgtacgtggcgccgacggtctgctcctgctgcggggtgagccgcgccggggcggtccccggggtgcacagcgggtcgggcgtctcgctggagaagtcgtcgaaggcgggtccgacggcctgccccggcgtccactcggtgttgaagtagttgtggttggcgccggtcacgtgcaacgcgctgtgcagcgcccgcccggagctgagcccgcgggtggcgtcgacgtacatctggccttccaggtccgagacgtcgccgtcgcagcccggcaggatcgtcgccgacggcacgtcgggctgcgggttctgcccgaacgcggtcggcccgatcagcagcaggccgcgaatcgtccagcgcaccttgccctggtagtcgtcgtgcgcgcccggcgccgggttcacgctgtccagcgcggcccggttgaccccctcgccgccccgggagtgacccatcagcaggacctgggacaggtcggcgggcggcgccgcgcgaacgatcgcgggcgcagcccggcggccgctgccggcccagtcggcccagtgtgcgaggtgcatccggacgagcgccgagcgcgcctgcgcgccgccgtcggcgtccgcgtcgtcctgggcgttgatcccgttcgccgagatcgacacggtgacgtagccctgcgaggccagcagttgctgcgcctgcaggtagccgcggtaactgggcaccggcgcggagccggcggcgcacggccagtcggcgctgatcgcgttctcgtcggtgccggcgaagcaggtccagtgccggccgtgcaggaacagcgcgagcggccgcttgccgggcgcgcccttcggcgccaccacgacggcctgcatctcgaccttggccttgtaggtggagaggtgcacccccggcagctggtattcaccggtcgtggtccggtacggccccggcactcccgggtcgaccgggttggccggcaggatcggcgggatgaccggcgagcccgccgcccggcgctgcaccgaagccggcgcggccgcgtccacccgcttgccgccgaccttgacctgcaggtccttcaacccaccgggcggggttccgggcagcgtgaacgcgtgcgggtcacgcgtgccccgggcccgtcccagcagccgatccccggaccagaactcgaccgcggcgtcaccggtccggatggcccgatcgctcgtccaggtcagcgaccggtgctccagggaccatccgcggggcagcgcgtcggccgtgctgcccggcggatccgccgaggcgggcatcggcaggcccagcagcagcgtgctcgccgcgatcgcggcgaccaagatttttcgcatgaggcccgttctagtaggccgacgcaaatatctagatattcttttattcaagatcagttggctggcggatcagccgcggagttcccggatgtcggcggcggagagaccggccggcgaacaatgcggcttcgcgcgcccgcaaagccggcactttcccctcgatggtgtcccgggccgccaggcgaaccaccgtcacgttgcggatctgcccgacccggtgcgccggtccaccatctgcgcctcgatcacctgttcctgctgaccggcgctcgacacgtcatgcccggcaggaggacgccgccggggtcacggctagcccgtccggaaggcggcgcgcaggaaggtctcgatggtggcgtaggtggggcgggccgcgtccggggtcagcgccggggtggtgtggcggacccgggctcgggcggcccgtggggagacgatgtcgcggttgtgacccactcccgggacggtgtagtacgtcgccgggacggccgcggcctgcagggcgtcgaagagcatgtcgctctggtccagcgggaccagagcgtcctgggtgccgtggatgatcaggaccggtggggcggcgggggtgatccggtgcagcgggttcgcctcggccacccgctccgggcagctcaggatcgcacaaccgagcagggacgactcgggtgaccgggcgtcgatgtggcagtcggcgagccggaaggcgcgattgaacgacgcgcacgcgccgggcagcatttgcgggtccatctccaggaagtcgatcggggcgtacaggtcgacgaccgcgcggacgccggggtcggtgaagccggcccacagggcggtccagccgccggacgagtcgccgaggacggcgatccgggcgcggtcgacttcgaagcgggccgcgttggcgcgcagccagcggatcgccgcctggatgtcctccacctgggccgggaacttggcctggtagctggagcgggtggagacgccggccaccgcgaagccgtgtgcggtgaaatacgggaccagaaccggggcgtagcccttgccgtcgtcggcgaaccagccgctgccacccatcacgatcagaagcggtcgcggggtcgtagcgggctgggccgggaggtagaggtcgatcaagtggccatggctgccggcgggctgcgcgggggcgtaggccaggttgcgcaggacgcgcggcgggcggacggcggcttcggtgggcgggccggccgcgacgaccccggcgagggtgccgagcagcagcgtggccagcgcgagcaggcgcgaaagcggtcggctgatcatgatgggctcccggcggctgtccacggcatcgcaccgatggtcacctatggtgaccactccaccatccgggaagccgccatggtgcggaatcccccagctcggttaccccgaggcgatcgtggcgagtgcacacgcgaggacgccgggcgtacggctacgcattctgcgtgacatggggatgcctttcgcatgccggggatccacccgtcgcgatggttgccgtggcgcgcggaaaggttgcccttggcgccggtttactgtttgcgcatgccgacgaaacgccgtgatgccgaggcgaaccgggaccggatcctgcgggccgcccaggagctgctgtcccggcaaccgacggcgagcatggatgacgtggcgcaggctgccggggtggtgcgccgcaccgtctacagccatttcccgacccgggaggcgctgctcgacggcctcgccgacaaggtgtccgggcatctgctgggcgcgctcggcggcaccgaccggtccgggctggagccggacgtcgcgttggccgatttcgcgttgaccgtgtgggcggtcggcgcggagtaccggttgctgatgacgctggccgaggccgatctgagcgccgcccggctgcacgagctgctcgccccgatccgggcgcagggcctggagctgctggttcgcgggcgggccggtggccggttcgccacccatctgccgcccgaactgctgaccctggcactgcaggggatgaccctgtcgatgatccaggcggtgaacgacggcgtgtggcacgacgacggcgtggccgcctcgacggcggtgctggtcgcggccgggttaccggtccaggcggcggagtcggccatcgcggcggcccgggacctgaaacttgcacacatctgagcaggaaggctaacctgcacgcacctgtgcagtttctctgcacgtggctaccccctggaggggcacccccgtgtcttccgctcttcaccgcctcgccgccgccgtcgtccgacaccgcggccgcaccctcgccggctggctgatcacgctggtcctgctggccggcggcggtctgctgatcagccgcggcaccgacgacgcgttcaccatccccggctccgagtcgcagcaggccctggacaccctgaagcgggtgttccccgaggtcagcggctcgtccgcgcagatcgtgatcaccggggtcgacccggcgacgatcaaaccggagatcaccgcggcggttcgccgggccgagcggctcgaccaggtggtcgccgtgatcagcccgttcgacgagcgcttccgggggaaccggaccgcccgggcggcgatcgtcacggtccagttcgacgtggcgttcatggacgtcaagccgtcgaccaaggccgcggtcgacgcgatcggcgcctcgatcccgcacgcgagcgtggtggtcggcggcgacgcgtacgcggaccgggtgcccaaaccgagcccggtcgaggggctcggtctcgccgtcgccctgatggtcctgctgatcactttcggctcgctggtcgcggccgggctgccgctgctcaccgcgatcctcggcgtcggcttgtcggtcggcctgctgtacggggtgacccgggtggtcaccgtgccgtcgaccgcggtcacgctggccatgatgctcgggctggccgtcggcatcgactacgcgctgttcatcctgtcccggcaccgggaccagctgcgcgacgggctgagcgtggccgagtcgatcgcccgggccgtcgccaccgccgggtccgcggtcgtcttcgccggcctgaccgtggtgatcgccctggtcgggctggtggtggcgggcataccgttcctcaccacgatggggttgtgcgcggcgctcgcggtggccatcgccgtactcatcgccatcaccctgatgcccgccctcctcgcgctggccggcgaccggatccgcccggccgcgaagccgcgtcagcggcagggacggatcttcgaacgctgggtcggcgcggtgacccggcacccggtgatcaccatcgtggtgctgctggccgggctcggcgcgctcaccctgcccgccggcgaactgcggctggcactgccggacggcgccagcgaggcgccgggaagtgtggcccgacggacgtacgacgtgatctccgccgagttcgggcccggctacaacggtccgctcctggtcaccgccgacatcatcgcctcgcacgacccggtcggcctgatgacgaagctgggcgccgagatctcccgggtgcccggcgtcgcgctggtcccgatcgccacccccaacccgagcgccgagatcggcatcgtgcaggtggtgccggccagcgcgccggactcaccggagaccgtcgcgctggtcgcccggctccgcgccctcgaaccacacttccggcaggagtacggcgtgggcaccgccgtcaccgggatcaccgcggtcggcgtcgacgtctcggcccggctcggcggcgccctggtgccgttcgggatcctcgtcgtcggcctgtccctgctgctgctgaccatggtgttccgctcggtcgcggtgccggtcaaggccaccgccggctacctgctctcggtcggcagcgcgttcggcgtcaccgccctggtcttccagcgcggctggctcgccaaccagctgaacgtcgcgcacaccggcagcgtgatcagcttcctgccgatcattctgatgggggtccttttcggactcgccatggattacgaagtcttcctggtctctcggatccgggaggagtacgtgcacaccggcgacgcccggcacgccatcgacgctggtttccgggcctccgcgccggtcgtggtcgccgccgcggcgatcatgttcgcggtcttcgcggccttcgtcccggagggcgccgccaccgtcaaacccatcgcgttgagcctggccgtgggcgtcttcgtggacgccttcctggtccgcatgacactggtgccggcggtcctggcactgctcggcgaccgcgcctggtggctgccggcccgcctcgaccgggccctgccctcgttcgacgtcgagggcgcaggcgtgacccgcgaactggccctcgccgactggccagaaccggacagcaccgacgtgatcgccgccgacgggctgcccttcctgccgcgccaggtccggatcggccccggcgaactcgtcgaagtggtcggcgacccgcacacgaccagcgcattcctgctcgccgtcggcggccggaccaccggcgtgtcgggccggatcaaaaccctcggccacgtgctgccgcaacgcgccggcagcgtacgcgcggtcgccgcgctgctgcgccgcccgtcgctgcgtgacatcaccgaggcggccgccgccggcccaccgctgctgctcatcgacggcttcgaacacctgccggaacgcgccctcgcgctggacgcgctgcgggccgccgccggccgcggcagcacggtgctggtgaccggtcgtgatcagcaccccgacatcaccgagaccattgaggtgtacgcatgagaacgctgccccgatgggccgccgcactgctcgtgccggtgctcgccaccaccgccctgctcgccgccttccaggacccggccggtcacctggagacggtgaccgcggccgtggtcaacggcgacgagccggtcaccgtgaacggcaggacggtgccgctcgggcgggaactcgcggcccgactcgtcgcgcacaccggcgacaactacacctgggtgctgaccggggcagacgacgccgcagccggcctgaacagcggaagataccgggtggcggtgaccatcccggcgaacttctcgcgcgccgcgacctccgtcggcaacgccgatcccgccacggcggaacgggcccgggtgtcggtgagctcatcgcgtaccgccgccggaatcgatccggtggtgagccgaaccttgaccggcgccgcggtcgccaccctcaaccagaccgtggtcgaaacgtacctggacaacgtctacctgggcttcaaccggatgcaccggcagctcggggatgccgcggacggcgccggcaaagtgtccgacggcgccacgcgggtcgccgacggcaaccggcaactggttgtcgggctgcggcagctcgcggccggcagcgacgccctggccgacggcaccgaccgcctcagcaccggcgcgtccaccctggccgacggcaccggcgagctccgcgacggcgcgaaccggctggccaccgggaccgggcagctcgcgaccggggccggccggctggcgagcggagccgggcaggtcgcggccggaaccggcaagctcgccgacggcctgggcacgctccgggacagcacgaagaacctgccgacgcagaccaggaaactcgcggacggcgcggaacaggtcgccgaaggcaaccggaaactcgccggcacggtggtcccgatcgccgaccagatcgtgaacgggatcgatcggctgcccgatctggacaagctggccgaccggtgcgagacacccgccgacgtgtgcgcccaacttcgcagagccgcggatgccttggcggccgccggcaatccggtggccgacctgcggaaccaggtggtcaccttccgggacgggatcagcgcgctcgccgacggatcgcagcgggtggcggacggcgccgaccagctcgccgaccggaccccggccctgaccggcgcgatcaatcaggcggccggcggcgccgcccgcctcgacaaggcgctagctagctaggaccaccgcggtacgccgcgccgggaccgccggtcaacgcctcgaaaacggcgcgcagtcgctcgccggcggcgccgccgacctggccgacggcctgaacgacggccggaaccaggtgccgacctacaccgacgcggaacgggcccacctgcgagatgtcgcggccaccccgatcgaagccaccgaaaccgcggtcggcggcctgaccgccgggccgatcgtggtcctggtcctgtggctcggcgcgctggtcacgctgatcctcaccccggcggcccgccgcgacccgctgacctggcacggcccgacctggcgactggccgtgctcaacgcgcggccgctgctgcgatacgcggcggcgcaggcggtcgtggtcagcgcggccgccgaggcgttcctccgcctggccccgctgcgggtgatcgccctgctggcagtcgcggtgctgatcggggtggctttcatattggtgatccaggcgttgctgatcggcttccgcaccgccggccggctcgcggccatcctggtgccggtcctggcgttgaccacggcggtgatctccgcggtgccgggcgccctgacgacgacggcgagctatctgccgacgtacggcccgatcctggccgttcgcgccctgaccgctcacggcggggcggccgggaccgggctgatgctgaccgtggggtggttggccatcggggtgctgggcgtcctgtgcgccaccgcccaccgccggacggtgccggtccgctatggggcggcgccgagccacgcctgaaccggaatcgagccggcgctgcgcaccgcgggcatgccgggtcggccgcctcagtccggacccgaagctgccgactggaccgtcgtgtcgctacgtctcccgcagctgtgcgccgcgctgacggcgacggtgctgctcgccggctgccgtcccgccacgccggcagaaggccccgccccggaaccgtcggcccgggcgacgtcgcccgtcccgctgccttccgagatcctggaagattgcggattgccgcccggaagcaccggcataccgagtgcctgccccggagtgctgggccccgacaacatcggtgtgccgaaataggcgctgcgccggccgtcctcggcggtcgtcgtcgccttgagcaccggcccgggccggcgctcgtcgaggaccgccagcaggcgcgcgctgcctccctgtttgcccggttccgggcacgttcaagggagatcgatggagtgcccccggcaggaatcgaacctgcgacctgcggtttaggaaaccgttgctctatcccctgagctacgagggcgcgagtgtccatgctacctgaccagggatgaccgcaagcacccgataacaccccctgctgaccagcagtgccgtggcggggagatccgactggggggcggatgaagcagtcgaaccgtggacagacggtagtctgcccactgatcctgatgagcgaccatggttgatcggtggtgaccacaggtcctcgagcacttctggatcggaaccgggggcggctggggcagacggggcgggccagccgcgtagatcctcggtcgactcgtcgagggcgggtaaggccggctgaacttcctccctgagtgtcaactcaaggtccaccagcccacccatccaacactggcgatgtccgcgggctacccgtttggctgcaccgactcgtctgccgacgcgagactccgccaccactgttcgtcgactaccagttcgccggtctcgaacaacgcccgctccaacgcgagaggatcgacggaccggacgggccctcgcctagcaaccgtgatgacgtgctctggcagacggagattatgcgcctccacgtagtacgcgagaccgtctggccagacgaaatgctcgccgtcggtccgctctgtacttccgttattgaccccgcagacgccgcagggcgagaagccagcaaaggcaacgatcggcgtcccggagcggggatacgcggccaccgcatcacgttccgcagcttgcgcaccgtcaccgagaaatgcgtggacctcgggccaaccatccagcgtcaccggaccacgccaatagccgatcagccgaaagcacactctggctcacggaacctccaaccacgcggaatccggacaggctaacccgcgaccatcgctcgattcagaagcgtcacaagccgccgatgcagccggcgccgaaataagatgccctgccggtgctagatcaaggtgccggaatcaggtgcaacagacgcgtttaccgcaagcctcaaatgatcaacttcggcttaggctcttcgccgttagcccccgtggctccacacccgagcgtcttccactttccagagcaagtcggtgtcacgggtggggtggtgcgcggcgagcaggctctccaacgcagcgacgtcgacaagaccgagtgcgtctgcgatccgccggtaggtgacaaagtcgatcccccggcgcagggtctcctgctcccatcccggtaggcccacaagggagtcgacgaagggcggctgatgccgtctgggcttggccgccgtctctacctcttccgaatcggccgccatccacgtttccaaccatctgcgcaagctgggtgtctccacccaccgaagtcgcaggcctgttcaaccttggcaccagctcgtcacaactcgagtcgacgagcaagcagttcctcgacagcgctcggatccacagagtgctcacgcagcagtcggcgacctgcatcatcaggatgggaaagaactgccaacagcaggtccgcacttccccccggtgacttcttcccgttcgcagcaagagtccgagccgtgtcacccgcctggcaagccggcagcgtccacggcgggttcttcgggctgctccgccaactccgccgccgctggggtgccgcgatagcaccttcctgcggcacatcagccagcgacacgaatacctcggaccgagtcatcccgaacggacgtagcacgaaatcgcaggagacagcgtattcaccggatgggcgtaagccggtcgaggtcagctgctcttccaacaccagaacagcgagaatgagatgtacgagggtggtccgatcgtgacccaaccgcacggcctccgcagtcgcttcctgttccaagaaagcgagagcgggactcgcctgcgcggccaacctgacgatcccggaggtaagccccctagtcaacgcggtcgaccgctgtagacccgggtgagcaggatccacgagagccccggctcgagccaaatggtccgccagattccggatcggtggtttccctccagcaaccggccaggtacgtcgcgccacccgcgtaaggcgatccaaatcgaccatctgggcttcgacgagcagaccagccgtgttggtcgggtcagccagaagggcttccaacaaatgatccggaccgacccaaggatccccccgtgctacggatatcgccatagccagtctcaacgctgcgaggacttcgtcatcccattgaggacgagaatcaccatcaacggacggtcgtccgaagacctgccagtgcacctctcgaatgacgcccaacaacatggggtcaatttcagaggaaggctcagcggagccaccgcgcctatcttctcgccttatccgacggacatcttcctcgggattatatcgaagcacactcctgaaattcgggaaggtattcaccagactaaccagtacaacattggcgccgatcaccggttggtgcaacttcaccgcggcacggcaagcgcccagcaaaacggcgctgagccccccacttacgtcaatcatgaagatcacctgaaagctgtgtcagcatatcaattagcccgatgcctaccactgtaatcgtcgggcgcacgatgaacagccggatagcctccaccccaatcatagtatgcccttcgcccatagaaggcaccataagcagcccgccccaccacatctgcaaccgatttccaggaatctcccggcagcatacctataattctcttcggcagactgttatcccattttgtgatagcaccctctgcagctccggcaacagcgtgacgcagtggataaacatcaagggattctggcctgccgtgcctgggctcataatcttcaccttggcttgattcgccctccgcacggtgagctccaccgcaattgtgtacgagtaccggcgtggcaccggcgagcacatagtacgtgtggaggcttgtgacggtgaggttgtgcatgtggtgcgcgccggtgtaggcgtgcactttggtgatcgtggtcgcggcctggccatgggtatcgcgcaggtggtggccgacctgaaggtcagcggcgtcggtccacttgtggtcgctctggtcccagaatggatggtgtgcggtggtgttgatgaccgcagaggtgccgtcggggtgtttaacggtgaggtcgacgaagtcgtggtcgaggttgtcgtacagggtttcgaccggttcggcggtgtccttgcccgtctgagggtcggtggcgcgaactttgtcgccgatcttgatgtcgctgatcggtttgctggtgccgtttgccagaagcaccagtgtcattgcggtgaaactatttttgcatgtactgggaggtcgtacgccctcctcctgcgatgcgacctcctttttaggtccggccttgacgccgtcgacgacggtcatgacgtcgagtgcgccgagggctgtgtggcctgctgccgcggcccagtcaccgtttttgacgtcgttggcgatgttgcccacttgactgaccgcgtcggcggcagcaaggggaacggctagtgcgccttcgagggcgccggcgccagccgagttgatcacgtcgacgacgccgtggatgttgccgtcgagggcgtcggtggtcagcttgccggcggcgccggcggccatcatgcaggcgggggtgcccgcgcctgcggtgacggcctcgcagcccatgaaggtggcgatgccgacgcccgcgccgatcagggtgttcttgttctcgctgacccagtcgacgccgcgctcccaccacgacttctttttcggcttcggctggttgtggctgccgctgccaccgtcgccaccgccaccactgccgtggctgctgccgccgccgttgtagtcgtgggtgccgtcaccggcaccgccgctgtccgggtcgccggtgtacgcggggctttcgcgtttcgcggcagcctggggcccgtagtactggtcatcaccgcgcaggccggtggggtcggactgcgtgatggggttgttgccgcagtaggagtaggcgttccactgctgcgggtcggtcaggtcctggaccgggtcgacggagatgaagcgtcccagcgccgggtcgtattcgcgggcgccgaggtgggtcaggccggtgggttccaggtcgccgccgacgaagcccttgttgttggcccaggtggggttggtgccgcgcggcgcgccgtacggggtctggcgccggatgctgacctgctgggtgtaggcgttgaccgcggtcgactgggtgccctggtggtcgctgaacagccacgtcaagcttcggtcagcgacggtccgggaggcgaccacggcgccgccgaaactgtagtagcgggtggcgtcgttggcggtggtgctggcgccgaggcggcggatctcctggccgggtaggaacagggtggcgccggtgctgtcgcgtcggatcaggcggctgccgtcagcgtcgaacaggtcggtggtgaccttgctgccttcgacggttttgaccgggtggccttcggcgtcccaggtgatggtctgggtgccggtgtcgccgggccggctggtcatgttgccggcgtcgtcgtaggcgtagccgaccgtggtgctgctctgcgccggggtggtcgtggtcatgccggtcaccgcgtgcggccggaccacatccttgccggcggtgggcaccgcgtagctgcgggaggtgtccccggccatgccgtgcgacacctctttggtgcggttgccgagcgcgtcgatcgtccagtcgatccagtacggggcgggcccgccgaggttggcgaccgtgggcgaagtcttgcagtccacgccggacttcggggtccacgccgacgtcagccggatcagcgagtcgtagacgtagcactgggtgtcggtctggcccacctccggcgcgtcggtgacctgctggatgttgccggatgcgtcgtagttgtaggtgcggtcggccaccgtgccggtcgcggtctccggcttgaccttcacctcgtgcacccggcgggtgtccccctcgtaggacatcatctgctgggcgtagaccccgccagtgatcttcagcatggtggaggtcggcttgccgtacgcgtcgtactgctgagcggatacgtagctgccggggtcagaccacagcgacttcagcgcggtcggcaggccgctcgccttgtcgtaggtggtctcgacgccttcgctagttagcgtcgccgctgccgggtaggtgatgccggtctccgcgccggtgtatggggaaaaactgtggacgtagctgtaggtgccgccaagtcccgtttcggctgccgggatgacccactgctcaacgctgacttggttgcgggcggagaaaccggtgggacgccagatgtagggctgccgggtaccgtcagcagctgtctcgtaacgggttgcctgggtgactttgccgtacatgtacaggccgttggcgagggtgtcgtacttccattcggcgcgtttgttggcctcggtgatgctgccgtcgtagagaccggttttgcggccgagggagtcgtattcgtaggccaggacgtggccggtggcgtccttggtggtgagcaggtcaccgaagtcgttgtaggttgagcttgacgcgcccttgtccgggtctttggtctcgatctgccggccgagcaggtcgtacttgtaggtccaggtgtcgccggccgagtcggctgccgaggtcatccggttcttggcgtcgtatccgtatttgacggtgtcgtgcccgccggcgatcccggcggcggtgttgtactgccacagttcggaggtgcggcccaggacgtcggtcagcgtggtggtcggggtgctgccggccggcggcacctgcgtggtccggtcgccttcgtagctggtggtggtccgccacttctccacgacgttggtcgtgccgtcgccggagcggaagatgctggcggtggcgcggccggcccggtcgtactcggtgagggtctgggtgggcaccgaccattccggttcccaccacagggtgcccgacggcgcgtcgggttcggcgtgcgcgccgaacgccatgtcggcgcggccgaactggtcgtagagggtgtcggtgacgacccgaccgccgccgacggcctcggactgggtctgccgggggcgcaggaaaccgtcatagatggtgaatgacgtgttggtgccgccgccggagttcagcgccaccgtcttcacgaacgggtacgtcttgcggtcggggtcgaagatgtagttgtaggtggccgtcggctgggcgaggtgcgccgacttggtccaccccgcatcccaggtctggaaggtccgacccagcgggtcgtaggtgacgtcggtgacccgcttgttgatgtcggagacgccgacggcacgatcactccgaactatccggacatggccatccgtgacttcaacggcgaccagaccaccgacgtcctagcccgagacaccggcggcaccacatacgtctacggtggtgacgggaagggcgtcttcgagccccagacctccgccgggaccgcattgtccggctacaacttcgtgctcagcccgggtgacgccaccgccaccttcccggtcaccctcgaccgcaccggcccggccatcagccacatcacccccggcgacatgaaactcgttcgcggcaccagcttcaccacgaccgcgtccgtgactgatcccagcggggtcgcagccacctccgtgaacggcgtcggcacccccggcaccgccgccaccggaaaggtgcccaccggacgcgacggccggctcaccgtcacctggcaagccaccgaccgcttcggcaaccagtcctccgccagccgcaccgtcgtggtcgacaacaccaaaccggccctcgcgatcagcgcggcgcccgccaccggcaccagactcacccgagccgccaccatcaccgccgctgccagcgaccacaacggcatcgccaaggtgcagatgctggtcaacggcaccgtcgtcgcgaccgacaccaccgccggctaccgcttcaccctgaacccggccaactacggcagaacgttcagcgtgcaactgcgtgcgtacgaccgagccggcaacgtctcacacagcagcacccgcacctaccaccgctgaaaccgaacaccagccacgacgggaccggccgcaccgagagccggtcccgtctacgctttcgccgtctccgcgttcgtgtcccgccgatcgcccgggatctcgggctcttcgcgcgctagcgaccacaatcccggcgaacgcccgatcccgaccttgagcacgccgatcggcttggggcacagctgctgaaccgtggcgatgaggtttgttgcgtcggccgacgcgtcacccaaggcgttgccttggatttcttcggggactgctgtcgtacctatctgaacgagataaatgccgctctggtgaatccgctgacaactttctcggcggtacctgagtcttcctcggtgtgacgaccgaaacgaagcaccgaccgaccggggcgatgagcggcgcggagcaggagttccgggtcttcgtcctggggatcgcggcctcgctgcaccgcacggcattcctgctctgcggagactggcatctggcggacgacctcgtccaggaggcgctggccaaggcctacagccattggcgcaaggtacagcgggccgagaacccctcggcgtacgtgcgacgcatcctgatcaaccaatcgcgtagccactggcgccggcaccgcaacgtgcccacgtacggcgacagcgacctggggcagctcacggttcccgatctctccgacggtgtggtgagccgcgcggacctggtccaggcgcttcagtccctggcgatccggcagcgggcgaccgtggtactgcggttcctggaagggctcagcgaacgggagaccgccgcggtcctcgggtgcaccgagggcaccgtcaagagccagacgagccgcgcgttggccaagctcaagtccgtcctgaaccgaggagaccactgaccatgccgaacgacaccgaggaacagctcagcacggcactgcacgacatcgtcaaagaccggccgtacacgcccgacttcgaccggatcgagagccgcgggcggacgttgaagaaccgtcgcctcgcctggcgcgccggcgggggcgccacgttcgccgtcgccgccgtgacggcgatcgcggtcgccgtcggcggcacgggaacacaggccccggcgcgtacggaggcgcagccgggcccgacgcggagcgccaccgccacgagcccggcaacatcggctacccagcagccgctggtgcagctggccgcctacctcaccacgatcgagaagcagcccggcgacgccgcgctcgtgcgacgcgacgagtggaacgcttacaactctccgcacaaggacgtggtgtgggacctgtacgccgacaacggcaagtactacttcgccaagacccgcgccgggctgccggcgaaggtgcgccacaaccagaccgacgcgggtgacacgttccgggtggcggtcgaggccgccaagtacgcggtgaacggtgatctgaccgtggcccgcaaaaagatggcggacatgaccggcgcctttcaggtcgaggatcccgggccgggcgtcgtcccgccctaccaggggccgattggcaagaaggtcccgaggcagatccgtgacgtgctcaaggtcaacctggtcgacaaccgggtatggctgaactcgatcttcgcgttggaggccggggccggcagcccgaccgtccgcgccggtgtgctgcggttgctgtcgacgctgcccgaggtgaaggtcacccagggcatcctcgacggcaaggcgacgctcaccctgaccgtgggcaagccggccatggccggcgaccgcaccgaggccctgaccatcgacgccaccaccggcgtcccgatgcgtttcctcagcggcgcaggcgcctcgggcgccaactaccaggtcacccgcgtgagtctcgcggacgtggccgcgggcaggttctgacaggccggtgccggggccgcacccgctcctacgaagggaagatgccgcgcccgattcactcgatgagtagatttcctcctcgttgcccgctgatcggccggatgcggggcagcctgctcggcttgatgcctcatgaacggccgggtgccgccgaaaggaaggcccgcggtgcacagcgcaccccgatgaggaagcggtgaccagatggcggcacgcgggaaggtggcggagcttgccgctgagctggacctgctggaggaggacatcgggtgggacctggccgagtcccacgctcgcctggaccggctgatcgaggcgctgcggccgtccggtgagagtgagctgttctggcgggcgacgcttctgcgggcggacgccatcgagcgtgagggtgacggcgcgaccgcggcgaggctcgtcggcgaggtgcgccggtgggcggccgagcacggctcccaactgctgatctcccgcacgcaccggctgctcgcccggctcgccaccaacgccggcgacctgggcggaggcctggagcacatgcttcagtgcgtgatggcgctgggggacgacacaccgccggcggaacggatcctggcactgatcaagctggccgacgcgttcgccgcgaccgggtcgatggcggccgcccgggaacggttcgagcaggccttggcggccgccgccgagatcggtcatctggaacggcagatgaccgccctgaacaactgggcctacagcgagtacgaggccggcgagccgcagcgctcctgggaggtgctgcagcgactgcgggcgctcgcccgggcgcacgaccggccgctggacgccgccgagctggacacggtggctcgggtcgcgctggagctggggcatgtcgaggaggccgagcgggccgcccgcgatgcacttgagctgtatccgcacgacaaggtcgaggccgatgcgcaggccgcgtacctgctgacgttcggcatggcgcggcatcggcggggggacctggagggcgcccgggcggcgctcgccgagagcgcggagctgtgcgaacggcaccggctcggccggctggccgccggggtgatgaccgagcaggcggccctgctcgcctcggcgggccggttcgaggatgcctaccggaagttgtgcgaggccaacgaggccgaacggcggcagcgggacgccgaccgggaggagcaggcccgcaacctgcaggcggcgtacgaggtcgccgacgcgcgccggcaggccgagtcgttccgcgatcaggcccgccgcgattcgctgaccgggctgcgcaaccgtcggttcgtcgacgaacacctgcgcgggctgctcagccgcggtggcaccggcgcgactccggtgatcgccgccctgcttgatctcgaccatttcaagcggatcaacgactcgctctcccatcaggccggtgacgccgtcctggtggcgttcgccggcctgctggcgcaggtcgacgcgggcgtcgacggcttcgcggcccggctgggtggcgaggagttcctgctggtgatgaccggtgtcgccgcgccggaagcgatcatgagggtggccgatttccggcggtcggtgctggctcaccgatggacgtcgatcaccggcgacctgccggtgacggtcagcatcggcgtcaccaccgcggcgcccgactgcaccgtcgcggacctgctcggtcgcgccgacgaggccctgtacgccgccaagcgggccgggcgcgaccgggtccacctcgacgagctggccgacctggctaccggagcgtcatgagcccggcctcccggcagaaagggtggtgccggctgcccaccgaggggcaaccggcaccatcgtcactcgtcaggcagccggtccgtagaccgccagctcggtcgagtccatgaacttgcagccgttcgcggtgcccggctggccggccgcgcacagcccggcgtcctgggcctgcgtggtcagcatcgtgtaccggacgtactcgatggcgtcgccggtgcccgcggccagcgcgaccggggtgggcgtgacggtgccggccgggaacttgccgctcgcggcgacagtccaggtcttgccgtccttcgacgtctcgatccggtagccgctggtggaggccgtcttgtcgtcgccacaggtggacgacgggttgacgaccagctgcgcgacgttgaccgcgccggacagacggatcacggcgttctggccttcggccgcgacgtcggaaccccagccggagatctgcgactggtcgagcagctcaccgggaccacagccgtacgccgtgtagtccggcccggtggcgctgatgatgcccgcgccgccggaggaggccgcccagtcgtgccggaccgcccagttctccgccttggtccccgagttgaccgacagcgtcttgacgatctggtcgtagccggcgccccgggcgtacaccttggcgtacgtgcccggaatgatcccggagatcttgtaggtgccgtccgcggcggtggtggcacggtagtcgccggcgaagccggaggcgtgcccgccgaaggcgatggtcaggccggccaccggggccttggtgtcctggtcggtcaccttgccggtgagcgtcccgcgcggggtgcccgcggccggcggcgtcgagaagtcctcgaccggctgggtgtcgtcgccgtcgatggcggcggcgaagtagcccatgccccgcttggcgaagaccttccagatggtcttggcgttcttgccgccgttgaccaccaggtcggcggcgatgatcgagttccgcatgtccaggtaggacgggttgtccggggacagctccataccgcgggtcacgatcgattcggccttggtgctgccgatcgcgcgacgcaggtcccacagcgtctgggcccagatctcgccgtccgcgtgcacctcggggccgcgcgaggagaccttgccgaagtcgccgtacgtgtaaccgccggggccggcgttcggggtgccggggcaggccgccgagacgatgccgacggtgcagtcgagaccctcgctgcggatcgtgccgccggccgaccagtacttgccgatcagcacgtcgccgggcttcgcggtgtccttctcgagaccggtggcgtgcaggtagtcctcggcgtaccagtcgctccaggcctcgcccatcgcgccgccctggatgttgctcagggtggagttgccggcggcgtcgatgacgagccggttcgacaggccgtgcgtgtactcgtggaacacgacgtcggactcgtcaccggtgttcgcggcgaccgcgtccggggccgggttcagcaggtacatctgcatgaccggcgggatgccgtccggcggggtgttcatgttcgcgttgtcggtgtggtcggcgtcgggcagacccttcgcggtgtcggcgccgtccatggcctgaccctgcaccgcgtcgccgtcgcgcgcctcgaagttgccggccgcccgggtgaagccgatcggcgaggacttgaggtggtcgtggaaggtgcccaggaacgtgaacagctgcaccgcgttctgcttgcggttgacctgccaggagttcgccgtcttcgggtcccacgagcaggggtacgcggcggagcagaggccgcccaccgcgacgttgaagtcggccagcgggtagtcccaccggtgcaggccggacgggccgacctcctcggtcgggtcggcctggttgttgtcgttcacgtcggagtagacgtgcgcgacgttgccggacagctggcgcgtgttgtccggcagccagcccttggcggtcaggtcgaccttctgcgggacgccgcccttgggtgcgcccgggtagttcttccacacttcggcggagtcgttcgcgatcgtgctgtggcggtagagcacctcgccgctgaccgcgtcgatgacgtgcacgtagccctcgtcgacgacgatcgtctgccaggccaggcgcgggcccgagacggtctggaaccagaccttcttggccgtgccgttgtcgctgaaggtggtcgtgccggccgccgtcttggtggccttggcggtggacgtgccgagaacgtccttgaccgccgcggcgcgggcgcccgtggcggtcaccttggcggcgcccgccgtggacggcagcgacttcagcggcgacccgtcgacctgcacgaggcggccgtccttggcgacgtgcgccttcaggccgttgccgaacaccggcacgccgtcggcgacctgcacccagctgaggtggtgggtgcccgcgacgtcgacatagtcgcggcgcagttcgagcgtggccaggtcggccgcgtccaggccgaagatctcggggtgggccttgatgtagtcgagggcgatcgtggtcggcttcttgtggctcgggccggtcaggaagccgtccagcttggccacccggcgcggggtgccggtggcccgatcgatgtcgacgatgccctgcacgccgagtttgttgcgcatgctctgcaccgccgaggcggacggtgcggtggcgaaggcgcggctcgatgcgctgcccttcgacgctgtcgccggcgcttgcgcctgggccgcggcgaccaggttcgcacgggaatcgtaatcggctcgccgcggcgccttgctgtcagtgccagcggtcacggcgcccggtagcggcgcggcctgtgcctgctgcggcagcaacgccgcgagcagaaagacaccggcggctgccgctcccacccgccgggttgcggacggtacggataacggtctcaattcagcccctctcgaccgggctaagctgcgcaccggcccggcgttaacctggtgccggcccgcatctcacaggtgtggcccgtcgatgggtgatgctcattgtcattggtgcacataactagagctatatttggatctttaccaattcgagatcacttcgcgtacgaaattcggacacatcagccgtaccgcacggcctctccgttcctcatgatcacgataggcagggcgggaagcggtcgtcgcatggcgaggtcggggccggatcttcctcatctcgaacggttcccggtcgaaggggagggccggcagcgacgccgcaccgcggcctggctcgaaacgaggctccatgaccgaagcacgccggaccgaccggagccccgcgcctgcgaccgtcgccgcgcttgccgcggagctggacgagctgacccgcaacagaggctccgacatcgcagtggccctgccccgcctgctcaaggtcgaacagtgcgccgccgaaatgggcgaggacatcctcaagtggcgggcgaccctgctgcgggctgatctcaccgaccgcacgggcgacttcgccgctgccgcgcggttgagctggcaggcgctgcagtggggcaccgaacacggctgtgcccaggtcgtctcccgcgcgcacgagctgatcggccgcggatcccgcaccatgggcgacccgctcaagaacctggaccacatgctgcaggcggtcgaggcactggacgacacggttcccaagtcggcttacctgggcattctggtcaagctcgccgatgctctggcggagaccggctcgatgccggaggcccgccagcgctacgaggccgccgcgcgcctggcgctggaggtcggcgatgtggaacgccaggccatgatctacaacaactgggcccacggcgagtacgaggccggctgccccgacgacgcccgcacggccgtcgaccggctcctggccttcaacacggcgaccggccgtgcgttggactgctgcgacctggacaccgtggcgcggatccgtctcctgctcggggagcatcgggccgccgaggaggccgcccgggccgcgctggacgcctatcgggagagcgacaaggtcgaggcggaccgcgaggcggagctgctgctgacggtcgctgtcacgcagcgtcaccagggtgacctggccggcgcgcaggtgtcgctggacctcagccgatcgttctgcgacgacctcaacctcggtctgctcgccgcgctggttcagcgggaacagtccgagatccatgccgcggccggccggtgggagcaggcctaccgggcgttgcgcgcacaccaggagatcgaaacgaagcgggccgacgcgcagcgcgaggcgcaggcccggaaccgacaggtgatgttcggcttgagcgaggcccgccggcaggccgaatcatttcgcgagcaggcccgtcgcgatccactgaccggcctgcacaaccgccggcacatggacgagcaactgccgggcctgctcgccgaggccgcgcgcaccggcgcaccgatcaccgccgcggtgctggacctcgatcacttcaagcggatcaacgacaccctctcgcacgaggccggcgacaccgtgctgagccggcttgccgcccggctgtcccaggtgccgctcggcgacgacggcctcgccgtccggctcggcggtgaggaattcctgctggtgatcacgggcgtccggccggccgaggccatcttccgcctcgaggatctccggcgggacatcgcggaggagtcctgggcgacgatcaccggcgacctgccggtcaccgtgagcatcggcgtgacgaccagtgacgccggcagcacggtgaacggtttgctcggccgcgccgacgccgcactgtacgaggcgaagcacggcggccgtaaccaggtgcgcgtcgaccccggatgcgacctgacggaacggcggtggttccgcagcctgcgctgaccgccgcgccacgcggcgtcgccgcgtccggtgggcagtgccggcggcgcgcaggctggtcgcgggcccggaagctacttgcccgccgcgccggccgcgcgcttggctgcggcggctttggcggccgccagtctggctgccgcccgcttggccgccgcagccttggccgcggcgatcttggcggcgatgctgttcgccttgccggcatttcccgcgccggcatcagccgcggccccattggccgccgcgccattgatggcggcgcacttggccgctatccgtttggccgcgtcagccttggcggcggcaattttcgctgcgatgcctttacctttggcacccttaccggcagccgctttaccgaacgccgcacccttaccggcagcggctttaccgaacgccgcacccttaccggcagcggccttaccgaacgccgcacccttaccggcggcggcgttacccgcggcattgtcaccggcggcctggccgttcgcggcacagaaggccgcgagacgcttggcggccgccgccttggccgccgcagccctggccgcggcgtctttggcaccggccgggttctggcccggcgcggctgcctggcgcccgccgaaggcggccagatcggtggccgcgcggggggtggtgctcgcgttcgcgaactgcacgccggtcaccgtgcccacccccagcacgccagccaccacgaccgctccgatcgccttacgacgacgtccgacagcacctcggtacacacgtgaacgcacgaaattctcctcgtcctcagcgttggtctcaccggttgtagatcaatacggagacagccgctcgaacggttcaacaattcttccgaccgcatgcattggatcgacgaaatcgaattttctcggccggtcgcggtcatctccgcaaagccggacggtagacccggccgccggtttgttttgatgggaggatgacccagcggacgtcacccgggaaacttcgcaggccgatctggcgcggctggatacatctcatctggttcctgctctccttgccggccggcgggttgctcatcgccggggcccgcggcgaaggcgcggtcgtcgcggccgcggtctacgcggggacggtcagcgcgatgttcggtaccagcgccctctaccaccgggtcagccggccgcccgcgctgcgccggctactgcagcgcctcgatcatctgatgatcttcgtgctgatcgccggcagcgccaccccgccgtaccagcttgccgtcccggcccgctaccacggcatctgcctggtggtgatgtgggcgctcgcggcggtgacggccaccctgcacgtggcgcgaatgcaggctccggagcgtgcggtcggcggcacctacatcgggctggcagccgtggcgggcctggctctgccgctgatctggatccacgccgggccggctgccggggccctcgcggtcgccggcggtctgttgtacgtcgccggggctctcgcctaccactaccgcaggcccgatccggcgccgtcggtgttcggctatcacgaggtcttccatgcgctggtcagcgccggggccacctgccactacgccgccgtcttcatgctggtgacataggggagaggcggtcctgacgggacttgaacccgcgacctccgccttgacagggcggcgagcactccaactgctccacaggaccttgcagaaggcaacctaccaggccccccggtcgccaccaacttcacggcgaccatgtccagaccgtgcagaggtaaacgccgtacgccgcggaaatcaaggtcatcgcggccaggaccgcgaccacggtggtccgccgcgcccgggccagcgtcgccgccaccggcagcagcagggggaacgccggcagcagcagccgcgccttggagtggtagtagccgtggccgaagaacgccagcgccacgatcgccgctgaatagatcttgagctgccacggcgccaccgggtccgtggccagcacggcgagcagggtcagcgcggcgatcagcagtagcgtgaccacgaaatacgccggcgtggactccccggtcagcagaccgcgcgccgccctgacggtgtatccgcccaggtcgtacgacatcctccaggcgtccttctgaacgtgcacgtatccgtcggcgcgtcccagccgccacccgacccaccccgcgtagccgagcaggccgatcggcgccagcgccgcggccgcccacggccgccagccgtcgcgtcgccgcacgatggcgaccagtgcggcggccccgaccacggcgatcagtgcggcggccgtcgggcgggtcaggccggccagcgcgcagagtgccgccgcggtcagccaccggccgcgggtcagggcatgcacggcggccgcggccagcgcggtgaacagggtttcggtgtagcccatcgactcgacgacggcgtgcgggaggaccgcccacagcccggcgagcaggatgccggtggcgcggtcgtgcagacgggcgccgaccgcgtagaggcagccggcggcgaccaggccggccagccaggcgacggcgatcccggcccggtccgcgccgcccgggaccagtgggtcggccagccgggccagggccgggaagagcgggaagaacgccaggttggtgggggccagggtgccgtcggcgtgcaccgggatcgcggtgtcgtagccgtgccgggcgatcccggcgtaccaggccgcgtcgtatgcgccgagcagcgcccacggatcgcggtgtttctcggccacgaaatgccaggtgaagatgaggctcacggcccgcagcaccaggtacagggcgaccgccggccaggccgggaacaacggcggcacgggagcgggagcggtgccggtccgcacccggcggaccggagcggccggagtggcgggggcgggcggaatccgcagcaccggaaggtcgctgacggccgggaagtcccgggagacgatcgagaacggctcgggcgcccgcaccgcgggccgcggccggcggcgggcgcgacgggggtgggcgactccggcagcctccggcgcgaacacggctctgcgcggcgaccggtcccgggacccggaccaggatcgggagaagtcgcgccggggcagccgtgtccggacacccgcgggtcgccgcagacgcgtgccggccacccgtccaccgtgccacatccggcgctcgcggtcgccggaaagggtgggatcgggggcgcatcatgacaaccggacggacggccgtccccgtccaaggggtgatgacccgacggagggtgcgtgacatgcgggacggcgcggagcaggaatacatcgagtacgtcacggcgcggatcccggcgctgcggcggctggcgttcctgctggtcggtgacgaacaccgggctgacgacctggtgcagcagacgatcaccacgctgtatctgaagtggcggcgggcgtccgcggccgagcacctggacgcgtacgtgcgcaccatgctggtccgcacgtatgtcgacgagcgcaggctggcctgggcccgggtgcggctgttccagcatgcgccggagccgccgccgctggagccgggcggtttcgaggagcgtcaggtggtccgggcggccctggcccggctgccccgccgtcagcaggcggtgctcgtgctgcggttcttctacgacctgccggtggaggacgtggcggcgacgctcggctgctcgaccggcacggtgaagagccacacctcccgggggttgatcaccctgcgtcgcctgctcggcgagccggagctcgccgtgacgaactgaggagccgacatgccgtccgattttgacctgttgcgttcgatcgacaccgagccgcgcgccacgtccacggtggacgtcggccgggcgatcagtacggcgcgccggcgacgcagccggcagcgcaccacctatgccggggtggcggcgctggccgccgtggtgctcaccggcggcgtgctgacctggcggccgtccacgccgaccgccgccgacagcactcccgggtcggcggcgccggtcggggtgaagccacccacgaggtgcaccgtgcggcagctcccgatcccggacggtgcgccggcagccctcgtcgccggcgccgaccggaccgggagatacctggtcgggcgctcctatccgaaggagaacgagtggcagccggtgatctggcaggacggcgccgccagcacggtgccgattccgggcaccttcgagaagcagctcgcggatgtcaacgcgtccggcgtcgcggtgggctggggcttttcgtcaaaaaccacctccttgccgtacgtcttcggcaacggccaggtcacccggctccccggcgtgaccggcggccaggctctggcgatcaacgacaggggagcgatcgtcggcgatgacggcagccggccggtgctgtggcggtcggccaccgcacagcccacccgcctgcccgtgccacccggcaccacccacgcccaagcgaccgatatcgaccaggacggcacggtcgtcgggacgatcgacgaccgcatcccttacgtatggctgccggacggcacgcatcacccgctcagcctgccggacctggacggtgaaccggtcgaggggcgcgccttccacatcagcggcggctgggtgtccggggtggtcaacacccgtggcgcggcggccgggctggccgcggagaggggcgagatccgggtggtccggtggaacctgcggaccggggccgcgaccccggtcacggcgttcgacaagagggccgacgcgatcaacgcgcagggctggcagaccgggatcgcggcgggcggcggtggcgcggtgctggtggccgacggcaccacgctgccgctgagtggcctggcaccggccggcgacgaccggctggcggtcatcgcgaacgcggtcagctacgacggccggacggtggccgggcaggccgacgacgccgccggccggatccagccggtggtgtggacctgctcctgaccggatcggcatggtcgggcgatcaggcgtggacggggatggcgctcgacggccaccgggaaaggcttggcggtacgccgtgggcgcgacgccgagggaagaagggcgcggcgattgttcaggacgcactgcggccacatcgccgcgtccgctcgcccccaagagcagcgatcagatatcggccgcggcgcacggcatctgaatgtgaactttattgatggggttctacgccgaaggcgacgtccagacggtatttcgttccggtgtagcgggactcgctcaattccagcggccggccttcctgatcgaggatcaggcgctcctccaccagtagcgcggtccccgcgggaacgccgagttcgcgcgcgtcctcctcgttggccggctgggcggtgatcgtcgacgttcccctggtcgggatgcggccgagcgccaccagcgcctcatgcaccgattgcgagaggtcgaagtccagcagtgcgccgagcaccccggggtagcaggcgtgctcgaaggcgaacggatccccgtcggcctgccggacgcgatagatggcgaccacgtccccggcccgctgccgcaatctggtggcctcgatgacggtcgccgggcgcaattccgcgctgacgacgcgcgacgacggctccttgccccgcttgcggatctcctcgctgaggcggatcaggttgtcggcgcggcgcgggccggtggggaccgcgacgaaggtgccgcgaccgggcgcgcggtaggcgaggccgtcgttgaccagctgggtgacggcggcacgcgcggtcatccggctgacgccgaactcgcgggccagctccggctcggagggcagtgggtcgtgcggccgggcctgcgcgatccgcgctcggagctcctgctcgatgcggaagtagcgcggcgcgaagtcgggtccggcggacatgaggcacaccctaccgatagcgacaacctgtctagacaggcggttgtctagacaggtacggttcggccctatggatttctcggtgtcgcagatcgcccgcatgatcgatcactccatcctccagccgcagttcaccctcgaggacgtgcgtcaggggtgtgccgtcgccgcgaagtaccaggtcgcgtcggtgtgcgtgcgcccctccgacgtgccgctcgcggtcgagctgctgcgcggcaccgacgtgcgggtcggcaccgtgatcggcttcccgcacggtgacaccagcaccgaggtgaaggccgccgagaccgagcaggcggtggcccgcggcgcctcggagatcgacatggtgatcaacatcggctggctgcggtccggcgacgtcgccgcggtggagaccgagatcaaggagatcgtccgggtggccggcgaggcgcacgtgaaggtgatcctcgagacggcctacctcaccgacgaggagaagctcgccgcgtgccgggccgccgagcgggccggcgcggcgttcgtgaagacctccaccggcttcgccccgaccggcgcgacgatcgacgacctcgccctgatgcggtccgccgtgtcggccaaggtgcaggtcaaggcgtccggcgggatccgcggcctggacacgctgctggcgatggcggcggtcggcgtcacccgcttcggcacctccgccaccgaggagatcctcgaagacctggcgcggcgacaggcgacaacctacgcccggcgcgcctgagaagcggcgggccgggcctcacaaaggcgccggcccgccgtacctttatgatcttggcgcgtgatccacaaacgactgtccaccatggtggcggccgggttgatcggcgccgccaccctgctcggcgccaccccggcacacgccgacgagaccgatccaccccgggtcgagctggtcctcgacgtcagcgggtcgatgcgggccgccgacatcgacggcgaaacccggatcgcggtggccaaacgcgccttcggcaaggtcgtcgacgcgctcccggcggacacccggctcggcatccgggtgctcggcgccacctacgccggcaagaacaggaaggtggcctgccaggacacccagcagatcgtcggagtcgggccggtcagcgcggtgcaggcgaagaacgcgatcgccaccctgaaaccgaccgggtacaccccgatcgggctggcgctgcggaaagcggccgcggacctcggcgacagcggttcggtccgccggatcgtgctgatcaccgacggcgaggacacctgcacgccgcccgacccgtgcgaggtcgcccgggaactggccgcccagggcacccacctggtgatcgacacgctcggcctgacgcccgacgagaagacccgcaagcagctggtctgcatctccacggcgaccggcggcacgtacgccgcggccaagagcgaacaggaactcaccgaccgggtgcagcagctggtcgaccgggccgtggtgccgccaccggtgaaaccggccgtggtcaccggcaccgcggcctgcgccggcgcgccgctgttggcgccgggcgtctacaccgaccgggagcagatcagccagcaccggttctaccgggtggcggtaccgcccggtcaggaactgcgcgcctcggtcagcatcgcgctggaccgggcggtcaaccccgactacggcgtgttgctcaccgcctcgacgcccggtggccgcgagctggtccgcgggctggacgccggcagcggacgcaccgatgtgctgtcggccgggctgcgctgggccgccgagcagggcagcgaagtctgcctgacggtgagcaactcgttcgccacggccaccaccagcccgctgggcatgccggtcgagctgaccatcggcctgaccggcgcctcgcacgccccggacgcccccggactcggccgcggcttcctgttcctgctggtcctggcggtcgccggactgatcgccggcatcctggccggctgggcgacccgctactgggtggccacctggagggagaactgatgcggagcacgacgtacgccgccgccgccgtcgccctcgcggccctcgccgtcccggcgccggccctggccgatgacccgtccccggcgcccgccgtacacctcgccggcacctcgttcctcaccgcggtgccgatcagcgccggtcagccggtgcaggtcggcgcggtcaccggcgactacctgtactggcagttcagcgcggacgccgggcagcggccggagctcaccgcggcggtcaccctgccggccaccggccgcaccggcgacgaatcctggatcatcgaggtgttcgacggcctgcgccgccggcaggcctgcgtggccggcgagcagagcccggtcgcggcccgggacgccgcgcaggtgaccgtcggctgccggatccggcaggtgcgctcgtgggccgagccgcaggacggtgacccgctgcccggcacctactacgtgcggctgtccagcaccaggacaccggagaccgacctgggcctgccgctcaaggtcagcctcacgctcaccgcggacagcggcgacctggacaccgaccagggcaccctggcccagcctctggtcccggacaaccggcccggcacggtgctgaccactccggcgccgtcggccaccccctcggcggccgcggacagcacgttcagcgcggactggctgccggacttctccggacgctggttctggaccgccggcggcggcatcctggccgccctgaccggcctgttcggcttctccctcacccggcgccgccggctccgctgacccctcgaccgccccgggaccggcactgcggtcccggggcggtgacgaacttctagaagtcgtcgtcgaaggtcacgctgccggtgacgccgacctggtaggccgagacccggcgctcgaagaagttcgacagctcctgcacgtcctgcagctccatgaaggcgaacgggttcttcgagccgtagaccggagcgatgcccagcacctgcagccgccggtccgcgacgtgctgcaggtactcccgcatgtcggccagtgacattccgctgacgccctgctcgagcaggtcggcggcgaactgcacctcgcactcgacggcctcggccagcatgtcgcggacctgctgctgcatctccgcgtcgaacaggtccggctcctcgcggcggacctggtcgaccacgtcgaaggcgaacgccatgtgcatgctctcgtcgcggaacacccagttggtgccggacgccaggccctgcaggacgccgcgggagcgcaggaagtacacgtacgcgaaagcgccgtagaagaacaggccctcgatgcacgcggcgaagcagatcacgttgagcaggaaggcccgccggtgctccctggtctccagccggcgcaggtcgaagaccgagtcgatccacttgaagcagaattcggccttgcgcgcgatcgaggggatgttctcgatcgcggcgaacgcctcgaaccgctccgcctcatcgggcacgtaggtgtcgagcaggttcaggtagaactggacgtgcacggcctcctcgaacagctgccgggacaggtagagccggccctccgggctgttcacgtgctgatacaggttgagcaccaggttgttcgccacgatcgtgtcgccggtggcgaagaacgcgacgagccgggacaccaggtgcttctccgcgtccgacaggaccgccaggtcggcgaggtcggagtgcaggtcgacctcctcgaccgtccaggtgttcttgatggcgtccttgaaccggtcgaagaagtgcggatacttcatcggccgcagggtcaggtccattccggggtcgagcagcattactggcaggcctcgcagatgtcggggttttccagggacgcggcgagggcaccgtcggtgtcgccgagcaggttcaggctgagggtggcgacctgacccgggccggacgggttggcgaccagggtggtggtcgcggccgggacgaccgggatcgtcgcggcggggacgaccgtggtggccgcgaccgccgtggtggcctgctggatccgcgtcgccgggcgcgagcgcaggtagtacgacgtcttcaggccggacttccaggcgtacaggtacatcgacgagagcttgccgatggtcggggcggccaggaacaggttcagcgactgggactggtcgatgaacggggcgcgggcggcggccaggtcgatcagggcccgctgcggcagctcccacgcggtccggaagatctccttcacgtccgccggcagcgccgcgatgtcctgcaccgaaccctcggcgcgcttgatcgcctcccggatctcgggggtccacaggccgcgggacttcaactcgcgtaccagatagttgttgatctgcaggaactcgccggacatcgtctcgcgcttgaacaggttgctgacctgcggctcgatgcactcgtagcagccggcgatggacgcgatggtggccgtcggggcgatcgcgaccagcagcgagttgcgcagcccgtgcgccgcgatccgctccttgacggcggcccagcgggcgccctgggtcatcggcgcaccccacagctccgggtgcagatcgccctgcgcggcccgggtctcggcgtacgccggatgtgccccgaactgctcggcgagccccgccgacgcctccagggaggtcaggaagatctcctcctgcacccgggtcgacagctccttcgcggccggcgagtcgaacggcaggcgcagcgtgaagaacgcgtcctgcagacccatcagccccagtccgaccggacgccagcgcgggttcgacaccgccgcctgctgcgacgggtagtagttgatgtcgatcacccggtccaggaacacgaccgcggtgcgcaccgtggcccgcagccgctcccagtcgaccccgtcggcggtggtgtgcgcgcccaggttgatcgagccgaggttgcagaccgcggtctcgtcgtccgagttgacttcgaggatctcggtgcacaggttcgacaggtggatggtgttgccgggtgcgccggtctggttcgacagcgcgttcgaccggtccttgaaggtcatccagccgttgccggtctgcgcgagcgtgcgcatcatccgcccgtacagctcccgggccttgatcttcttgaccgccttcttctcggcgatccggtacgcctcggtgaacgcgtcaccgaacaggtcgggcagttcgggggcgtccgaggggtcgatcagcgaccagtcctcgtcggcttcgacccggcgcatgaactcgtccgggatccagttcgccaggttcaggttgtgggtgcgccgcgactcctcgccggtgttgtcccgcagctccaggaactcctccacgtccgggtgccacggctccaggtacacgcacgccgcgcccttgcgccgcccgccctggttgaccgcggccaccccggcgtccagcgtcttcaggaacgggacgatgccgttcgacttgccgttcgtgccccggatcaacgcgccccggccgcgcacccgcgaccaggcgatgccgatcccgccggagaacttcgacagcttcgcgacctggtgataccgctcgtagatcgagtcgagctcatccttcggcgagtcgaccaggaagcacgacgacatctgggtgtgccgggtgccggagttgaacagcgtcggtgagctgggcagataggccagcgacgccatcagccggtagaacccgatcgcctcctgcgcggtctgcgacagtccacaggccacccgcatcaggaagtactgcggggtctcgaccggcacccgcttgatcgggtgccgcagcaggtagcggtcggcgaccgtgcgcagcccgaaatactcgaaccgcaggtcgttggcgacgtccacggccgcgtccagctccgcccggtgcgccaccacgaacgcgtgcgcgtcgtcaccgatcagcccctgcgcgaagcccagctcgatcgactcgctgaacgtggtcgcaccctgctcccggacctcctgctccaccaggtcgatcagcaggcgcgcggccagccgcgaatactgcggctcctcgccgatcagctccgcggcggtctggatcgagagcttgtccagctcctcggtggtggcgccgtcgtacagcccgctgatcgtcttggtggcgacccgcagcggatccacctcgtccagcccggtgatccaccgctccaccgcggtcacgatcttgttgacgtcgacgggctcgaactcaccgttccgcttccgcacccgcatcacgtgccgccgctgctccggcacgccggtcttctccggtgtgagcgtcatggcgccctcttccccctagcgagtcaacaggccgaaacccgcgcgggaagacaccgacatcccgccgacgcgcgcacgcgttcggcggaccccctcggcgtcggccgtcccgcgcggcctccgaccgccgcacacggtcgtatgcggcgcgctggcaggtcttcggactcgcgggcgtgtatcgctttcctactggccgtcgcttcccaggctcacgcccagtgctgatgtgacggcggtcgttcccactcaccgctgcggggcagtcccggtctcgcaccggattccctcttgcctcggcaacccatctcacaggccaccgaaccagctgcgtccgacactatatatgggatcgacatgcacggtgcaacgccacatggtgtgtcgcacacccttgcgcccactcccccgaaagcccccaaaagtagatcccggacggattaccggcatcctcgtgcagtacggcacaccgcccctgccagcgcgcccgcgccagatcgtcgatcatcgccacgcgcgcccgggtcaaccgcgaaaccccggcgccggccggcgccaccgcctcggtcaccggctgcatggcgccgatccgccccgccgcacccggcttcagcacccgatcaccgcctccgcaggcggtatcgcacgaagccgatggcgaacagcagcggcgcgacaccgatgatggagatgagggtgacgagagcggtcacccaccgccttggcggcacctcggcacgcgagtaaccgacgctgccccggctgcccgtgttctccccgatcgtgaaggtgtccccgggcttctcgtcggtgaagaagccaggcttgccgatcatcacccgctcgccaccgccgccgttccaccgaatggacacggcacacgctttgacatagccgaatccgctgagaccgatcggcccatcgcgctcacactgctcgacggtggcctcaccggtacggcgcgcatcagcgatgtccgcgcccgtgaagcggctgatggtgaccgccgtgccgaacagagctgccgagatgaccatcagaatcaccacgaacgccacctcgatcagccagctgcccgggccgccctcgaccgtcgccgccgcctccatcgaggcccgcgcctcagcacgctgctcctctgcctcggccatcagctcggccatgcgacgttttcgatccgccgcacgcttctcatggctcatcacacgctcctagcgatatttaccggggcatgtccacatcgggggaggtctcggcgtcgccgatcatggcgtcgccggtagctccgccgttctggatactgtttcctttgagcgcttcccgtatggcatccgaggcgatctcgatcttcgtgccatagacggcatcgtcagcgtcgccgaaggttcggtacgcctctttccacccaccccatgacccgctgctgtccgccgggtaggtatccgcattgaccttggccgagttgaggagcaccgccggcatgctgatgtccgaggcgaccttgtccaaaaaacctctgaggaaagcacagagcctttccagctgcgggaacttcatccccagccggaccatgtcagcggaaagcctccgcagcactcgaacgatctttgcggaacattcggcaaccatcatcgccacgctggtcaacacctcagggatggtcaccaccagaagcgcctgcaacgccttcgagatcgccgcaccgacaacctcggcgatcagatcgcggacggtgttgcgcaccaccccgaccatcgcgccggcagccagcgtcgcgtcggccacagcgccggacaccacgcccagggcacgaaccccgtcggctatcccggccgccttcgcccggtactcgtgaacggcttgcgcttcccacggggccgtggcggccgtgacctgggcggcgaagaagttcaccgcagcgttgacctgatcgcggacattcctccaggtggccgcatgtccttcgatctccttgggatcaccggccagccagtcgagcggctcccgtaagcaattcaggtgctccatcagccagccgacgccggccgcgaacaccgcctggaaaggatcgagcacggcgccgagggcgctcatcccggcgacgaccgaattgccgaacccggtgaggaagtcaccctgagaaaagccgtcggccgcacccgccacggcttcgaggatgcccgcgccctcgtaccatttggtgtccgcggccggcgccgtcagcggagcccgcgagacggcgaaggagtcgctcaccggatccgcctgaggccggccgcggaaatcccatcggtctcctcgaaagcggtggccatggtccgcaattggtcggcgagccccctcatcccctcggaagcgtggcgcatcacgtcgatgagctcatcgccctggggatggagatacaggttggtgaagagggggccgatcagatacccgtacgcgtcgctggacattcgagcgccggcaccggccgaccgggcttcgtcgagcatgcgggcgacctcgtcgacatcgcgagcatgccggcggacctcgtccggggaaatctccacgctcatcgacggttctcctcgtcgacagcgggcttcgggtaccgcttcgcgtatgcctcgttgatcagcgccgcggttccggagtccgagccgtagaccgaggccaccagctcaccgacgtgttctgcgagccgcccctgcgcacggtgcgtcgtctccaccaccaagcgcgccaactcgtccagcgagagccggtcggcctccgggtggaatcgcaggtcggccagcccgccggctgaattgacccgcacgctcacctcgccacccggcgcgcgcccggtcgcctcgatcgcctccagggccgcgctgaaccgaagcgtgcgctgcgcactctcctcgacccgcgcctgaaaggagcgcatggggtcatccacatcgaaccgcacgatcacacctccccgtcgccgtcacactcaagcgcacgcctgcggatcgcgatcggttcagccaggaagtcaggcacttcgatttggcacatacgagaacggcgggacgcccggtggggcgccccgccgctcagctagccgggagcgggatcagcagcggccgaggtcttcccactgctgggtccagccgggttcggaaccctgggtccagtagcgggcccgccacaggtgttcgccctgtccggacggcggcccgctcgggtcgccgttcttgctcttctcgtgcttgaccagcgctccgcccaggtagaccgagctgaacgcccactccggcgcatccgagcagccggttgcgggcggctgcgaggtgggcggggaggacggcggcgtcgacggggaggatggcggggtggtcggggtggagcaggtgccactggaggcgaccgtgtcgaggaagccggtgccgccggtgcggtaggcggcggcctgcgcggtggcctgcgccggggagagcacctggttcttggcgaacagcacccagtcgatctgctcgttgtaggtgctcttgccaccggcgtgggcggccaggtcgatgaaccagaggttccagttgatcgtcatggtctggcgcgggtagtacttgccgccgtggtcgccgacctggacgccgtcgatccagtagacgacgtgtccgttggcgacctgggcgaccaggtcgtgccaaccgtccaggctggatcgttgcgaggagtgcaggttgtcggcgtaccacggatcgttttgataggtgtaccaggtcgtctggtagttgatcggcccggtttcgccccagccgccgttcggcaggtattcggagatgtcgagttcgctgtaggtggggtcgaggtccccgttgagcgggctgatcgtgaagaacgtctcgttgatgtggtcgccgtcggtgccggcggccggggtgtcgctgaatctgatccggctggcgtacgtgccgtccaggaaccgtttctgggccgagtacagctcggcgtgcccggtgccggccgcggtgccgtcggtgtacgcggtgagctgggcgaccttgtcgccgttcgcggtggggaaggtgatgttggccggtgaccaggtggctccggcgacgccggggccgccggagtagctgcgcggggtccagccgttcgcggtcagcgcggcgtccgacgaggtgttgtagtgaaagtcgtcgaagagatagccgcagtcggcggcggaggcgggcgagccggagctcagggcgacgatgccggatgccgcgagcaccgccgccaccatcccggacaatcgacgtttatcaatcttcatggacagactcctcccagggggatcggggatgccgggatcaggcggtgcgccggatgcgaccggtgtagcgcgcctcgatctccgcgttgtgttccttcccgccgggcacgttgtccgacaggtagaccggcggggtgacccccgccgcgatcagggtggcgaccacctcggtgacgatctgctgggcgagcagcgccgcggtgatcgaggagacggcgccgaccgcgccgccgccggggaggggcaggatcgcgtcgccgtagggtgcgccgttgtccagcaccacgtcggcgatctcaccgagtttgcggccgctcgggtgccgggacgccacgcctgccgagtgttgcgccgaggtgatcgcgatcagcgcgtgcccgtgttccttgaccagcagtcccatctcgacgacggcgccgttgatcccggagttcgaggcgatcacgaacgcgtcgtccggcttgatcggggccagttcgtagaggcggtgcgcgatctcggtgccccgctcgaccatcgggtcggcgagggcttcgagcgggtcaccgccgtacagcacgatgtcgcgcagggcgatccggttggtcggcaccaggccgccggcccggccggcgatctccatggccagggcctcggagtggccgcagccgaaggcctggatcacgcccccgttgagcaccgtcgtggcgagcagctcggcggcgcgccgtttctcctcggcctgaccggcgccgacccggtcgaccacggcccggacctggtgcaggaactcttcactggtgacgctcacggttgtcctttcgcgcgcccgcggcggcgggtcgggatcttctcgggcagtcggtgggcgtcgaccgcgcgcacggtcagctccagcgcctcggcggtccgctcgaaggtgcgctgggcgaccgcgacgtagatcaggtcgagcacgagcagctgggagtgcagcgcggagagcgcggccagccggaaggtggtctcctgcaccgaggtggtgaagacgacgtcggccacctcggccagcggcgaccgggcgtagctggtcaccgccacggtcagcgcgccgtggtcggcggcctcggcgagcgtctcgatcacctcgcgggtgcgaccggagtgcgacagcccgatcgccacgtcgccgggcagcagcagcgccgcattggtcagcgcggtgtgcgagtcgggccggtgccagatcggcacccggatgcgttccagccggaacgccatctcccgggccgaggtgccgctgctgcccaggccgaagatctccacccgctgggcgccggcgatcgcggccgccacccgttcgaccgcggcgacgtcgaggccggccgcggtgctctgaatggcccgggtgtcggccgcggtgaccacgccgagcacgtcggtgagcgggtcgtcgggggcgatgtcgccgctgatgtcggtctcccagcgggcctgttcggcccgcccggtttcggtggcgatcgcgacccgcaggctggcgtaccctttgaagcccagcgtgcggctgaaccgggtgaccgtcgcggtcgaggtgccggaccgctcggcgaggtccacgatgctggcgtgcgccgaggtctccgggtcggccaggatcgtctcggcgatccgggccagggcttccggcatgcccgggccctcgatccgcagtcgcccgagcaggccgccgctctcaccggtcacggtggtcatccttttcatagattgttgttgtcgatgaaaattacgaccgctgcgacgtctagtcaacaagaaatattcatgcttcgatccttgggcatggagctggtgctgggagtcgacgcgggtggcaccgggacgcgtgccgtgctggccggtccggccggcgtcatcggccgaggtcaggccggtcccggcaatccgatcgcggcgggccgggcggcgatcggggcgatcgccgccgctatccggcaggcgctgggtcaccgttcccccgcgggcgtacgacacggcgtgctgggcctgtccggggcgagtgccctgcacgacccggcggtccacgacctcttccgggacatgtgggcggggatcggcctgacctgcccgatgatcgtggtcggtgacgtgctgaccgcgttcgcggccggcaccgcggcggcgtccggtgcggtactgatcgccggcaccggcgcgatcgccgcgcggatcgacgacttcaccgtcacccggatcgccgacggtctcggctggctgctcggcgacgaggggtcgggccgctggctcgggttacgcgcggtgcgggcggccgcccgcgatttcggcaccgggttcgccgcccgggtcgccgcgcacgccggcgtcggctcctgcgacgagctggtccgctgggctcaggcgctgccgctggacgcgatcgccgcgctggccccgatcgtctgcgacgccgcccgggccgcggatccgaccgccaccgcgctggtcgccgacgcggcccggcggctgacccgcaccctggacagtctcggctcgcccggcccggtcgtgctggccggcagcctgctcaccgccgacaccccggtccgcgagatcctcctggccacgctgcgcgcccgcggcgcgacggtcacgctggccggtgacccggccgaagccgccgcccggctggccgtccacctcgcggagaacgggaaccggccgggaattccgcaacgattcccggccggcccgcacccatcgtaaagagccggtccaccggcctcggagaccgaacccgaccggcggacggccgggcgtgctgtgcccggcatagagcaaccccgtaacttcggcgcatgatccctcgttcgcccggaccccggaccccggaccccggaccccggaccccggaccccggaccccggaccccggaccccggaccccggaccccggaccccggaccccggaccccggaccccggaccccggaccccggaccccggaccccgtggacgaccgtcggccattcccggacggtgctggtcgtcgcccggacggtcacggcgctcacccgcctgctggacgtactctcgctgatcgccgccgaccgccgcatccagatcgtcttcaccgtcgacgacgaacatccggcgatcttcgaggccggcgtcaccgccctgctcgacgacctggccccccgcaccatcgactggcggcaggcccgcaagacccggttcgacctgatcctgtcggccagcgagaacgacggcctggccgacctgaccggcccggtcctgttgttcccgcacggcctggcgttccagaagttctatccggacagtgacgtcgtggccggtctgcgccccggccttccggacggtgtgaccaccgcgctgacccatcccgcccagagccgcaccgcttccggccggaccgccgtgctcggcgatccggcctgggcccggatgctggccagccggcagcggcgcggcgtctaccgcaccgcgctcgacaccaccggccgccgtctggtcgtgctcgcctccacctgggggcccgactctctgctcggcaccgtcccggatctgccggaacggctggtcgcggacctcccgatcgacgagtaccggctggtcacggtcctgcacccgggtgtctgggcggagcacggccggtggcaggtgcgcgcctggctcgcgtacgccgccgacgccggggtgctggtgctcgacccggattccggctggcaggccgctctgctggcggcggatctggtggtcgccgatcacggttcgctcggcgggtacagcgcgctgctcggcgttccgctgctgctcggacctcggccgagtggcagcaccgtgcccggctcggtcgccgcgcgcctcggcgaacagtgccaccgtctgaatccgcacgccgcgctgcgcccgcagatcgacgccgtgctggacgggcacgatccggaccgttaccggcgggcggtggccgatgccgtcgtcgagccgcgcgacaccgcggcccggttgtcccgctgggtctatcgcgcgctggatctcccgcggccgtccgcgccgcccgggtttccgccgctgccggtgccgctgccggtgccggcgccggtcgccgcgtgggtggccggcgttcacgaggagcccgatgcgatcgcggtgtcccgttttccgctcgtcggggaccggcacgaggatctgccgtaccggcacgtcgtggcccgggtggaacgggcgacgctgacccaggtggccggcgctgcggtcctgggggtcgacgccgccggcgacgacgacttgttccggctgtggccgcacgcgcggctggtcgtctccgtcgacgatcggggctgccgggcccggttccgcgacggcgacgcggtgcacatccgtgccgatgatccggtggtcgacccgtgggtgctggcctcctgggcgtactggcggatgcggcgcggcgagtcgccggtgggcacgacgcggctgcgggtgggccgccgcctggtcaccgttgtcgcggtcagtcgccgagggctgccagacgacgactgaactcctgctcgcggggatgcttgtcccgggcgtagtgaatcgcgagccggctcaggcagtcccgtgcggtctgccggtcgccctccagctccgccagccgggcctggagttcgagcagctctccctgatactggccggcgccgctgagtccggtcagctcgaccgcgcgggcccagtcgcgccggccctcgacggcgtccccgagggacagccacgccttggcccggaccgtgtgcacgcgggcggcgttgcgcgggtctccggccggcaggtgcacatcggccagcaggtccagtgcgtcccggccggagccggcctcgatcagcacgttcgccagcatccgcaggtgcaggccgagcgcccggcggtcgccgatggcctgatcgatgtccaccgactgccgcagcagcgccgcggcccggtccagcgcggcggggtcgccccgccgggcgatctcctgttcccggcgcgcctgcgtttcccgcagggacgccgtcagttgcgggtcggccaggcccgcgatgcccgcgtcggcccggtccgcctcgtgtccggcctgttccagcaggccgagcagagtcaggatccgggcctggacgatgtgcagccggatcaccgccgcggtccggcccagcgccgccgcgctggccagggccgattcgttggcccgcaggcaggtccagtgccggccgcgcatggtgagcagggcttccagcgctccggcgatctgcaccacctcggcgtggtgcccgcggaagtgcgcctcgcggagcaggtcctcgacgttgtgcgcctcggcggccagccagtccaccgggcgcaccgcgggaaacggccaggtgatcgccggcggggccgggtaacgccgcagccggccgtcgcgcgcccggtcggtgacaccggccgggtccatcgccaggtcggcggcaccggccaggtcccggaaccaggtgagataccggtggaaggcggcgttcgaggtctcctcgcccggccgcagcgccgtggccgcgtagcgccgcaccgaccacgggaagctcagccggccggaccggtcccgggtgatcagcgaggtgtcgagcaggtccgcgatcaggtcgcggctcgggtagccgagccacgcgctggcgccggcgtcgctgaggtcggtgccggggtggccggccagcagcgccagcccggccgcgctgtccgcgccgagcagtccggcgctgcggcgcaccgagttcgcgaacagcacctcgacgcccgggtcggtgcggaaccaccgcacctcctcggccaccgcgtccggcacgttgccgcggatcgccagccgaccaccgaactgacggagcagggccgggtaggcgtcgcagagccggatcagctcgtcgaccgcgtccggttcggcggcgagcggcccgcgaccgcagcggtcggccaggatctgtctggcgctcgccgggtcgaccccctcgacgggttcggggcggccgggataccaggcgcgcaggtccggggtgagctgccgggtggtgatcagcacggtgccggccggcccgatgtgcgccaaggcttcggcctcctcggcgcccacgaggttgtccagcaccaccaggcagcgaccgcggcgcaggaagcgccggtactgcaggtcgacgtcggccgcggtcacggccacctcgtcgacgtcgagccggcgcaggatgcgctgctgcacctcggtgatccgcaggaccccgccggtccggtactcgtcgaggtcgatctcggcgtagccggtgagccggtcccgcatgtcgacggcgacctgccgggtcagcgcggtcttgcccgactcgcgcgcgccgttgatcagccagacgcccggctgggcgagccgtcgccgcaggtcggcatggtcgacgtagtgcggctgctcgtcgacgtggaccgcgtttcggccggcggtcgtcaccaggtcgtcgaggagctcccggaactcggcgtcctcctcgatcaggcgccgcaggtaggcgcggcgctcggccggatcgtccgggaaacggctgccccgtttcaggaaccggtcgatcaggcgccggatcccggcttcggcggcgttggccacgccgggggcgatcacccgcacggcttcggaggtgagcacctcgatcgtggacattccggtcactccccctcgcgcgcgcggccttcggaagctaacacgtgccgggctacaaaagggacggtcaggtcgccggataggcccgggtctcgctggctttgaccgcgacccacagctcacggccggggaccaggtcgaggtgggcggcggccgccggggtgacgtccgcggcgaccacgagcgggccgtcgaggcgtacccggacattgtcgccgtgccgctggatgtcggtgaggacagcggaccaggtgttgcgcgggctgccatccggcttcgccggatgcagcgcgaccgccgccggggggaaggccacgaacgcgtctccgtgaacgatatcggtcgcggtcagcaccacaccgctttccagccgtacggcgtgaccgtcggcccggccgcgatagaggttgagcccgaccagctgggcgacatagtcggtgcgcggccgggcggtgatcgtggccgcgtcgccctcctgcaccacccgaccgccctcgatcaccaccagccggtcggcgagcaccagtgcgtccagcgggtcgtgggtgaccagcagggtcgcgccggggtgggcggccaggtggcgccgcagctcggcccgggtctccagccgggtgcgcgcgtccagggcggccagtggctcgtcgagcagcagcagtgtcgggtcgaccgcgagggcccgggcgagtgccacccgctgcgcctggccgccggagagcaaccgcggcttgcggcgggcgaacgcggtcaggccgacgcggtccagccagtggtcggcggtggcgtgcgcggtccgccggtcggcgccgtgccgccgcgggccgaaggcgacgttgtcccgggcggacaggtgcgggaagagcaggtagtcctggaagacgacgccgatcgggcggcgttccggcggggtccgggacaggtcccgcccgtcgagggtgaggtgcccgccgcccagcggggtgagcccggccagggcgcgcagggcggtggtcttgccggccccgttcggcccgagcagggcgaccgtctcgccgcgcgcgacggacagcgcgatgtcgagctcgaagtcgccacgccgcaccaccagccgggcgtccagcagggcggtcacggcgtggtcagccagcggtcgcggagggcggccaggatggtcaccgagacgacgagcaggatcaggctgagcaccaccgcgccgtccaggtcaccgctctccatggtctggtagacggcgatcggcatggtctgggtgattcccggatagttgccggcgaaggtgatcgtcgcgccgaactcacccagcgcccgggcccagcagagcaccccgccggccgcgattccgggcgccaccagcggcagcgtgacgtgggtgaaggtggtccagcgggtggcgccgagggtggccgcggcctcctcgtaccggctgtccgcgccgcgcagcgccccctccaccgcgatcaccaggaagggcagcgccacgaacgactcggccaccaccacgcccgcggtggtgaacggcaggctcaccccgaaggtggccgccagccagccgccgagcaggccgcgccggcccagggcgagcagcagggcgatgccgccgaccaccgggggcagcaccagcggcacggtgaccagcgcccggaccagccgccggcccgggaagtccacccgggccagcagccaggccagcggcacaccgaggagcaggcagagcgtggtggccaggctcgcggtcagcagggacagccggagcgccgcgagcacctcgggccgggtgaggcggtccggcagcgaggcccacggagtgcgccccaggagcccggcgagcggcaggaccaggaagatcagtccgccgatcgcgggcaccagcagcgccaccgggacccgacgtgtcacggcgtctggaatccggcggcggtcagcaccctggtcccctccggggagagcacgtagtcgacgaactcgcgggcgccggtcgggttcgcggccctcttcagcaccgcgatcgggtactcgttgatcgcctcggcggattccgggaactcgacggcgtccacctgcgcggacgccgtcctggcgtcggtgcggtagaccagcgcggcgtccacctcacccagttcaaccttggaaagtgccgctttgacgtcctgctccagcgtcaccggggtgagcttgacgccggaggccgcgagggcgctctgagcggccgcgccgcatggcacctcggcggcgcagagagccaccttgaggcccggtttcgcgagctcggccagaccggtgatgtgcttcgggttgcccttcgcggtggcgatcaccaactgattcttcacgaaggtggtgggggtgacggcggcgtcgccgatggtcgccatgttcctcgaggcggccgaggcgaacacgtcggccggggcgccctggttgatctgggtggccagcgcggcgctgccggcgaagttgaaggtcacccgggtgccccggtgcgacgcctcgaactgcctgccgagcgtggtgaacgactcggtgagcgaggccgccgcgaaaacgctgacatcggtgggcgtggtgtccttcgccggagacgagcacccggccaggctcaccgccaacagtgcgacggctgtgacgcgtttcaaccgatcctccccggggtggcccgctccaccacgacggtggtggatttgatcactgccaccgccagcgagccgacctggaggtcgagctcgtcgacggcctcccggctcatcagcgacaccagccggaacggtccggcctgaatgtccacctgagccatgacggtgtccttgaccaccgcggtcacgatcccgcgcagccggttgcgcgccgacgaggaatcggaccgctcggccgcgtccgcgttccgggcccggacgaagccggccaggtcggcgccgtcgatgacccggtgaccgtgctcgtcgcgggtggcggccagccgcccggcgtcgacccagcggcgcaccgtgtccgggctgaccccgagcagatccgccgcctcgcccatcggaaacaccgtcatgccactcaccctagtcaatcgcagttgccatccggcatggcgtcccccacgcgcatcctcaggctctaccaatgaatcggctcgcatctgcggaaaggcgaaaaagcccttcgccccgggcaaccgttcccgccccggcgaccaccgcgagcggcacctggaacggcctgccgcccactgtcgccctggccgggccgaacgggcagtacgtcgcacccggcatgacggcggtggtccggccgggccaccgtccttctccgatcagatgtcgaactcgccgtcgaagaccccgccggtgaacgcgtcccactcacccttggtgaagaacagcgtcgtgccggtgtcccgggagttccgcatcgccgcgccgccgtcgggcagccgggcgatctccacgtagccgtcctcgtcgttcccggaccgcagccagaccgcggtcgccgggtcgaacgcggcggcataccccttcgcactcatgcgccgaccctaggacacatcggccggtgcggtcagatccacgatcgtgcatggtggagcgcccggtgggtatccgtgagctacatcacgaacacgtggaggtattcccatggcgcaaagcttgggttcgcctgccccggcctccgaaccaggaacgatccggagcttgatccccgcacgcatcgaccggctcagctggtcacctttccatacccgcatgatcctggcgctgggcaccgcctgggtgctcgacggcctggagatcaccatcgccagcgcgatcggcccggtgctgtccgacaaggcgaccctggcgatgacctccgccgaggtcggcgcgatcgccaccgtctacctgatcggcgaggtgttcggcgcgctgttcttcggccgtctctccgacaagctgggccgcaagaacctgttcgtggtgaccctcggcgtctacctggccggtaacgccctcaccgcgctgacctggggcagcggcaccgcggcgatcgtcttcctgtacctgacgagattcatcgccggcgccggcatcggtggcgagtacgcggcgatcaactcggcgatcgacgagatgatgccggcgaagtatcgcggccgggtggacatcggggtgaacggcacctactggggtggcgcgatcctcggcacgctgggcacctttgtcctgctcaaccacatgaacctgaacctgggctggcggctcggcttcctgatcggcccggtcatcggtctgtgcatctggaacctgcgcaagcatctcccggagagcccccgctggctgatcatgcacggccgggaggccgaggccgaggagaacatcgcgcagatcgagcgggcggtggagtcgtccgggcagacgctcgccccgatcgacgacagccgggccatcgacatccggccgacccagtcgcacggttacctgtcactcctgcgggtgctcttcaagcagctgccgcagcggtcgatcctcggcgcctcgctgatgatcacgcagtcgttcctgtacaacgcgatcttcttcacctacacgctggtgctgaccaagttctacggggtggatgagaagaacgcgccgatctacctgatcgcgttcgccgccgggaacctgatcggcccgctcaccatcgggcacctgttcgacgtggtcggccggcgcaagatgatcgccgggacgtacctgctctccggtgtgctgctggcgatcaccgcggtgctgttcaacgcgggtgcgctgaacgcgatcacccagacgatctgctggtgcgtgatcttcttcttcgcctcggccggggccagctcggcgtacctgacggtcagcgagatcttcccgctggagatccgggcgcaggccatcgcggtgttcttcgcgatcgcccagtgcttcggcgcgatcggcccggtcttctacggctggctgatcggcgagggcgacgacccgggcaagctgttcatcggttatctgatcggcgccgcggtgatggcgatcggcggagtcgtcgagatcttcctgggtgtcgacgccgagggcaagtccctggaggatgtggcgactccgctgtccgcggtggtccgcacggcagactgacgcaggtcagcgcgggtgcgcggcgacgaactcggcgatgtactcgtcgagccggcgctgcggctgccagccgaggccggccgctttggtgaggtcggccttgccgcgcacccgctccccgggcagcgccgggatcagctggaactcggcgccgaacagttgcgcgacctcggccagcggccactcccggccggtgccgagcaggtagccgtcgccggcaccgccgcgggcgaccaggatcaggccccgcacgatgtcgtcgatgtgggtgaagtcgcgcgtctgggtgcccggggagaccacggtcagcggctcgccggccaggtactgccgctcgaagatgccgatcacggtggcgtacttgccgttgccgatctggcccgggccgtacacgttgtagaagtacgcgatggcgtagtccagcccgaaccagttcgagtagttcttgatgtactcgatgttcttcgccttggtccaggcgtacgggttcaggttctcgtcgtcgccgtcgttgccgaacttggaactggagccggcgtagatcagcttcgcccccgccgaggcggtgaacttcaccacctccttggtgcccagcacgttgaagtcccaggtcaggtcgtggtcctcgaacgactgcacgatccgggagtattcaccgaggtggaagacgagctccggagcgggcagcccgtggccggcccagatcttggcgatctcggcggtcgagccctccaggtaggtcacccgcgggtcgtggatgtggttcgccggcgagccggtgaagtagttgtccaacgagacgacggtggcgtcggggaactcggtcagcagggaccggatcagagccgtgccgacgaatccggcgccaccggtgaccagcagagtttgactcaacgtagttcccaacccctcagccgcggcaaatgcgccgccaaggctaccaagcacagcggccgcacccgaactggtcgggtgcggccgcggccggatcgatggaagggtcaccaggcagaaggcgccggcggcggaaccaccgcgggacggtcgtcgcaggtgatcacgttcgggacgaacgggccgagccagcccccgtcgttgccgccgagatcactgagggtgaactcagacccgctgggcgtgaagtggaaggaaccgcagttgttcaccccgaccgcgccgacgttgcgggcgtccacgttctcgaacgtggcaccgccggcggcgcgggcgctgaccacgctggtgccggtgccgtccacccggatgtccttgaaatgcaccccggtgatcgcgtaccggtccttcacgccccagtcggacaccagcatgatcgcgttgtaggtgttgtcgaggaagtcgtccccggtcacccggatgtccgcgtcgatgccggcgtccagtgcgaggaaccagatcgccccgaggccgatccgccagttcaggtcgtacgtcccggcccgcaccgtggtgttgccggtgatccacaggtgtccggtgaacggctcggcgccgaaccgcgagccggcgtggatcccgctgccctcccggatcgggtcggccaccaggttgttcgagacggtgttgtccgcgccgccgtagacggcgatgccgttggccagggtcggcgtctgcaccgtgtcgtggtcgaaggtgttgccgctgtccgcggtcttctccgaccacatggccaggccgtcgtcgccggtgttgcggatgaagctgttccgcaccaccgagccggtcaccccggtgtggaagttcagcccgtcggcgatctggtcgacgatgatggtgccgctgatcgtggtgttcgccatcgggccgtcgaaccacagcccgaccttggtgtgctggatgtacaacctttcgatcgacgagtcgctcatcgcgccgccgatcccgttcacctggtcggtgtcgatccgctcgcggacgtcgccctggatcgcgaagtcggcgaggtggacgtcgtgactgccgccctccttgccgtagaaacccaccccggtgtgcaccgagccgtcggcggccggcgtggacagggtgacctggtgacccttgacgacggtgtaccagttgccggccccggtgacggtcacgtcgtcgacgacgatgtgccggttcacctggaacgtgccgggcggcaggtagaccgcgcggtggaccttccgggcgaaggcgatcgccctctcgatggcgcccgccgcgtcgcgccggccggtcgggtccgcgccgaacagcagcacgttcaccgcgcccaggtcgaccttcggcggcccgaccagctccgagtcgagcaggtcgatcgtggtcggcacctcgcgcgcggtgagccggatccggtcgccggcccggtacgtgcggcccagcgcgagccgctgctcgtcgtagaagtgcatcggccggaacggctcggtgatcgccggcgccggcgtggtggcggccggcacacagccgcactcggtgatccaccagtccgggtgcagcagcccggcccgcgggtcgtcgctgaacggatactggttgtacagccaggagtactgcgaggtcagcgtcatggtgcgggtgccgcccggggtgccgacggacagcggtgcggtgatcccgccaccggtcgcggcgtccgggatgctgtaccgcacggtgatcgcgttcgcggcttcgggcagggtgaactcgacgtactcccccgggtccagggtgaccgcggagcgcccggaggcctccgcggcgagcgtgtacggggtccggtcggggctcagcacactgccggtggtgacggcctgctcggcttcctgctcggcgaatgcgacggtggcgccgcggccggcgaccagggccggatcgagggcggcccgggtggccgcggggttggcggagggcggatgggccagggcgggatcggtcgggccgatcgccagcacgccgagaatgaccagcggtgtgaccaggagagcggcccagcggggcggagcggacatgccgccgaccatagaatcgtgtgatctgctccacaagggtcggtcctgttttgccgatgaaatgcttggatctttcatgcgagcttggatttcttgcggcatgctcgtcatctcgatgctcgccgcttgcagcgcccggccggcggcgccggcctggacccggatcaccctccccggtggggagcgcgcgacgttgcgcgacgcggccgcttgcggcgaccggtggtacgtcgtgggcgccgtcccggacggcgacgacacccgcccggccgcctggtccagccccgacacggtgacctggaccccggtcaccttcgccccgctcccggacagcttctacggcccgcacgaggtgatctcgacggtggcctgcgccggtgaccgggtgacgatgctcggcggggcacccggcggcgcgcacggcaacctgcggatcagcacgtggcgccggctgccggacggccggatggcggagaacccggcgccgttcgcgacatacggcggcgacaccgcggtcgacaccgagcacctggccgccgggccggccggcttcgcggtcgccggcaaccgctcgtccggcgccgccgcctggctctcccccgacggcgccggtttccggctgttcgagaacgcccccggcctcgccggcccgggcaccgccgcccgtgacgcggtgcccctgcccaccggcggctgggccgtgctgggcagccgcaacggtcacgccgcggcctggatcacggtggacggcagccgctggaccggcgacgatcccccggccgccggcggtttcaccgagttgcagcggggcatcccggacggcgccgacctgctcgcgatcggcccgcacgaccggcggctggcggtctggcgccggcacgacggcacctggtcagccctcggcgacttcggcaccgcacccaccggggtcgcgtcattgacccgggcgaacggcaggttcatcgcggctggcgacgggctgtggtcctcggtcgacgcgcggcggtggcgggctgtcgacgtaccggagaacatcgtggccgtcgccggccgcgaccgtctgttgctggcggtcgcggccgggactctctacgtgactacaccttgaagcggtcgacgatccggcgcaggtcggtcgacatcccggccagatgcgcggcggaccggtcggcctcggccacgccgaccgtggtgagctgcaccgacgcggccactccggtgatcgtttcggctacccggccacctgcctcggcggcctcgccgacgttgcggctcatctcgttggtggtcaccgtctgctcctcgacggccgaggcgatcgtggtctggaagtcgttgatccgcccgatgatctcgctgatctcctcgatcgcggcgaccgcgcccgcggtgtccgtctggatcgcggcgacccgctgaccgatgtcctcggtggcccgtgcggtctcctgggacagctccttgacctcgctggccaccaccgcgaaccccttgcccatctcaccggcgcgggccgcctcgatggtggcgttcagtgcgagcaggttggtctgctcggcgatggcggtgatcgtcttgatcacatcgccgatctccgccgacgactcacccagcttggccatcaccgcgctggtgttcgcggtgacctcgaccgcccggttggccacctgcacggccagggtggcgctctcgctgatctcccggatcgacgcgcccatctcctcggagccggccgccacggtctggatgttgaccgacatggtcgccgccgagtcggccaccgtggccgcctgctcggcgccctcggccgcgctggccgaactctgccggctggtctcggccaggccgccggcctcggtggccagcgactcggcgtgcgcggtcaggtcggtgacggtctgccgcagcgagccggtcgcggcgcgcagcgagtcggccatgtgcccgagctcgtcgcgctgccacacgtccgggtcgccggtcaggtcaccctcggcgacctggtccagcacgccgctgacccggcgcaacggcacgatgatcaaccgcgccacgagcagcgcgctgccgagcccgagcagcagcgccagggacagtgccacgatcaccagggtgcgcgtgcgggtcacggtgtgatcgaagctctgaccggcgagcagatccttgttggccttgtcgagatccgcggtgagcagcgcctcgtaggccttgcgcaggtcccggttcgcgcccaggcccagcgtggtggctttctccgggtcgctcttgtacagggcgaactcggacttcagcgcctcgaaccaggtgtccgaggccgcccggatcgcgtcgacccgggtcacgtcgtccggggcggcgatcgcccgcgccgcggccagcgacgcgtcggccttcgcctgccggccgagcgactcgtcgctgaacttcgcgtcgcccttgagcaggaagccccgctcgtcgttggcggccgccttgagctgcagtgcggcgtcgccgagattcttgacgtacggcgccatccggccgacctcggcgttgcgggtcttctccatcgcgctgatcccggtcacactgagcacaccggtgacgatggtcccggtgatcgccactccggcgaccgcgagcactttggtggcgacctttcggtctcggcaccactgccccagcccacggtttccggtcatggtgatccctctcttggtcggtaccgtaatattcggcatccggcgggagggactgaccgctgcaacggagaatcaacccagcgcctccgcgcgtctgcgcagggcgcggcgctccggctccgaggtggctgccgcggcggcgcggcggaacagcccggcggccatccgatggtcaccggcccgctccgtgaggtccgcttctgcggccagcgcatagccgccgaccgcgccccggacctcggccagaagatcaaggccggcttgcgcgccgtacgcgtatccgtgcgccaccgcgcggttcaccgccaccatcggggtcgggtggacccgggccaactggtcgtaccagcccgcgacggtcggccagtcggtggccgcgaagtcacgcgcggtggcgtggcaggcggccaggtgcgcctggatcgcgtacggcccggtgaccggatgcgcggtcagcagcccgaccgcctcggcgatcgccgcgtgatcccagcgggaccggtcctgctcggccagcggcaccaggtcgccggccgggtcgcggcgggccgcccggcgcgagtgctgcagcaggaacagggcgagcagggcggcgacctccggctcggccggcatcagcgcgaccagcagtcgggccagccggatcgcctcctcggcctggctgtccgcggtgtcgtagccgtgcgtgaacagcaggtagagcacggccagcacgccgggcaggcgttcggccagcgccgggccctgcggcacccggtacggaatcccggcctgctcgatcctggctttggcccgggacagccgccgggccatcgccggctcggcgaccaggaagagccgggcgacgtcagcggtcggtaccccggccacgacgcgcagggtgagcgccacccgggactccggcgccagcgccgggtggcagcaggtgaagatcagccggaggcggtcgtcggccgccggcggtggctcgtcgggctgcagcaaggccagctcctgaagtttgcggtcggcggtggcggcccggcggagctggtcgatggcccggttccgggcggcggtcatcagccagccgcccggattccccggttcgccgtcgaccggccagcgccgcagcgccgtctcgatggcgtccatcgcgcagtcctcggccagcgtccagtcgccggtcagccggatcagggtggcgacgatccggccgaacgactcccggaagaagacctcctgcaccgcggccgacctcagccggcccagtaggggcgcagctcgatccggccgccccaggccatcgggtgggcccgggccacctcgatcgcctcgtccaggtcggcgcattccaggatgtcgaagccgacgatcacctctttggtctcggcgaacgggccgtcggtgagcagcagttcgccgccgcgcacccggaccgtggtggccgcctccggcccgaccagctggttgccggcgacccggcggccgttggcgtcgttctccgcgacccaggcgaagatgtccggcgccgccagctcggtctccggctcggtgtcggtgcagacgaacatcatgtacttcatggacggtctccctgttcggtcggtttcactgaggtgacgaacggccggacccgatcaggacaccggaacgttgaatggcgtgattatttccggcggcgccccgtcgcggagtaccgcgttgatccggaactgccgcagcagcgcgagaatctcctggtcggcgccgtgcgcgacgaacacgtcaaaattccgcccggcatcctcgaacgccgtgatcaccccggcgcagccgtccggccgggccgtgtagaccgcccggacggtgtgtgtgccggccagcgtcgccggcacctggccgggatcggtcaccgtccgcagccggcggccgggccccagcgccgaccggaacccgtcgatccgcttcccggttcccggaccggcgatcaccaggacgtcaccggcccggtcgtgcagccactgctcgatcaggtaggcggcggtggcgccggccgcgaagtcgtccggctccgcgcactcccgatcaaggtcggcgaccgcccggcggacccgggcgacggtgctgtcccggaccccgccgcgccggtgcagcacgcggtcgacggtggccgggctgagaccggcccggagggcgatctcccggatccggtggggctgcttcacgacgtacaggatgatgggtttctgaggtggcatggaaggtctttgatgtcattgcgccccatcgcgtgacgtaacctccccacgtgcgcgtgatctcccgctgggccgacggcggcgtcgaagtcttcgacgagtccctcgagccctgccgatccttcccggttccgcccgaggtcgagggctgggcggtgccggcgagccgggacagcctgatccatgcgatcggcaacacggtgatccggatcggcccgggcgccgaggaacggtggcgctgcgatctcagcctgcgtgaacggccgacggcttggcccagcgccgtcaccctgtccgcggacgagacccggatctgggtctacgccccgggccgggaggacggccacgacgcctggttcgtgctcgacgccggcaccggccgggagatccggcggtaccggctgccgaccggtggccagcgaggacagcagttcccggtccgtgacggcagcatgctgctcagcgtcagccgcggccaggacggctgggcgacctaccgcgccgggccggacggcaccgtgcacgactacgcctgggatgaccgcgccctggtcgacctctcccccgaccagcggcagttcatgaccgtggaccactggcaggaggacgtcgccttccacgacttcgccgatggcgcggtgcgcttccggatcggcgccgaagccttcgggctggaccggccggacgtggaatacgccggcggatatctggacgacgagaccgcgatcgtggtcgccgtcgccgacgacgactcgtggcggcacttccgggtcggtgcccgcaccggagaggtgctgggtgacctgggaatcatgacgatcgacgagtatgacctccagccgctcggcgacgggacctatgtcatcaccgacaccgacggaactctcaggcgcatgtgatcaagcgccgaagaagataaagtagtcaccgcctatccgagaggcgctgcaacggacagcgaagtccgccacgctcgggtgcggtgttgttgacgtaagggcgcctcctgatgagggaggagccctcttttcatgagcgacaaacttcgatccgtcaacggtctcgacttcgcgatcgccgacatcaacctggccgaggccggccgccaccagctgcggctggccgagcacgagatgcccggcctgatgtcgctgcgcgccgagttcggtgagtcgaagccgctggccggcgcccggatcgccggttcgctgcacatgaccgtgcagaccgccgtgctgatcgagacgctggtcgcgctcggcgccgaggtccgctgggtgtcctgcaacatcttctcgacgcaggacgaggcggcggccgccgtcgcggtcggcccgaccggcacggtcgacgccccggcgggtgtcccggtgttcgcctggaagggcgagacgctggaggagtactggtgggcgaccacccagctgttcgacttcggcaacggccggggcccgaacatgatcctcgacgacggcggtgacgccaccctgctggtgcacaagggtgtcgagttcgaggcggcgggcgcggtcccgcagaccaccgaggccgactcacacgagtactcgatcatcctggacacgctgcgggcgagcctggccgaggacccgcagcggttcacccggatcgccgccgagatccgcggtgtcaccgaggagaccacgaccggtgtggcccggctgtacaaactggccaaggagggcaccctgctcttcccggcgatcaacgtcaacgacgcggtcaccaagagcaagttcgacaacaagtacggcatccggcactcgctggtcgacggcctgaaccgggcgaccgacgtgatgctgggcggcaagctggccgtggtctgcggttacggcgacgtcggcaagggctcggcggagacgctgcgcggccagggtgcccgcgtcgtggtgaccgaggtcgacccgatctgcgcgctgcaggcggcgatggacggcatgcaggtggtccgcctggaggacgtggtcggcgaggcggacatcttcgtcaccaccaccggcggcaccgacatcatccgggtcgagcacctgcaggcgatgaagcacaacgcgatcgtcggcaatgtcggccacttcgacgacgagatcgacatggccggcctggccaaggtcccgggcgtcgagaaggtggagatcaagccgcaggtgcacgagtggcgcttcccggacggccactcggtgatcatcctgtccgagggccggctgatgaacctgggcaacgccaccggccaccccagcttcgtcatgtcgaactcgttcaccaaccaggtgatggcgcagatcgagctgtggaccaagcccggcgagtacgcgaagcaggtcttcgtgctgccgaagcacctggacgagaaggtcgcgcggctgcacctggacgcgctgggtgtgcgcctgacgacgctgaccaagaagcaggcggagtacctgggcgtcgacgtcgagggtccgttcaagccggagcactaccgctactgagttataagcagtaaatagttcccctatgtcggttttctcgcggttaatctgcggcttccgacatagggggattttcatgcgacgtatcttcaccgccttcggcctgaccgccgcgatgctgctgccgctgaccaccgcgtcagcggcgaaggcggccccggcccgcctcgatccggacgcggccttcctgcgcaccgcccaccagggcgacctcgcccagatcgcgatcggccgactggccgtccagcgctcggcgaacccggtcatccgccacctgggcacgcgcttcgcggcggacagcacccgcctcgacaccgccgtccgggccaccgcccagcgcctgcacgtccgcctggacgccgccccgaacgccaccgtccagcagagtctggcggctttcgaaaccgcgcagggcccggccttcgaccggttgttcctgaccggccagaccggactgcacgcccaggccgcccacctgatccgcgccgaactcaccgatggtgacgagccggccgtccagcagatcgctcgccgcgcgttgccgctgatcaaaaggcatcggctcgccctgaaaaatctgggtaacaagatccgctgaattatccaaccggcgcgggataacgaagaataggcagatgagccacgaggagacccttcttttcggtctggtggccatcacgatcatcgtgatcatcgtggtggtgcgctggatctccgggaagaccggcctgcccgccgccgtcctgctgaccgtcatcggtatcgcctatacccgcctgcccggcaagaacatcgaaatcgatccggatctgattcttaccttcatcctgccgccgctgctctacaccgcggcgctggattcgtctctgctggacatccggcgcaacctgcgcaccgtgatcagcctctcggtggccctggtgatcgtcaccgcgctcctggtcggcctcggtttctccctgtgggtgaccggggtcggcctggccgcgggcatcgccctgggcgccgcggtggccccacccgatccggtcgccgcgctggcggtgggccgcaaggccggcctgcccaccaacctgatcaccctgatccagggcgagggcctgctcaacgacgcgaccgcgctcaccatcctgctggtcgcccgggacgtggcgatcggcgccgagcacttctcggtcaatgccacggtcggccggttcgtgcttgccgcggccggcggggtgctggtcggctgggcggtggcccggctgatccggctgttgcgggtgctgcgcgccgacccgctgaccgcgaacgcgttgtcgctggccaccccgttcctcgcgtacctggccggcgaacgcctgcacgtctccgggctgctggcggtggtggtggccgggttgatcatcgggcacgacaccccgcggtacgcgtccggcgccagccgcctgcagaccagcgccgtctggcggctgatcgacttcctgctggagggtgtcgtcttcctgctgatcggccagcagatggacggcgtgctgaaacatctgaagaactacgagaccagcacgatcctcgccgcgctggcggtcaccctgggcgtggtgctgttcctgcggccgctctggctggtgctcacgcagttgctgccgcggtcgctgcacactcggctgggcggcgaggacgactccgggacgatcctggagaagtcgctgaccggccgcgagtcggcggtgctcagctgggccggcacccgtggggtgatcacgctcgccgccgtctacagcctcccggacaccctgcccaaccgggatctgctggccttctgcgcgttcgcggtggtgctggtgaccctggtcggccagggtctgaccttcgccccgctggtccggtggctgggtctgaaggcgaacgagaccgacaaggcgaagctgcgcaacgaggcccgctcggccgcggtgcgggccgcgctgaaccggatcgacgacatccagagcgagcaccacgaccacgtcgaggacgaggccatgcacaccatgcgcaagcagctgcaggtccgtctggaccgctaccagcaccggctcgacgtgctggaacaggtggacaccccggaggtgccgccgtccccgcagtacgaggcggcgctgatggtgcgccaggcggtgatcgacgccgagcgggaggagttgctgcgctggcgcgacgccggccggctcgacgacgagaacctgcgggtcctcaaccgcgagctggaccacgaggagctggtcctgccccagcggaacaaggggcactgagtcggccggccggcgggtttcccgccgaccggccgcctttcaggcggggatgtcgcggcggcgcagggcggtcagcccggctccggacagcagggcggcgatcaggatcaggacgatttccggtacgacggtgaaccccgccgcgggcagctgcggcacgtgcgtgaacggcgagatgtccagcacccactgcggcatcccgagcagcccgcccaccagcagcaccagcaggcagatcgccaccgagccccaggccgccgcggagtgccggggcagcgcgccgaccagcagcacggcgatcgcgccgagcacccacaccgcgggtgcctgggccagcgacgcggccggcacccggcccggttcaccgaaggccagcccggccagcaggccctcgacggccagcgcgaccaccggcccgagcagcacgaacagcaggtgaccggcagcccagccgacccggctcgctcgcgtgccgaggatcagctccgcgtggccggtctgctcctcgtcgcgcatccgcagggcggcctgcaccgcgtacagcgagatgaccagcccgcagagcccggcggtggtggcgaagtacgcgtcggtgaccgtcccgctgccgccgagcctgctgaacacgtcgctgaccccgctgctctcccgggacagctgcaccacgctggtgcccaccccgccgaagaccagcccgagcgcgccgaagccggcggtccagccgagcagcggccccggtgcagccgccaggccaggccgaacggcgaaccgagcgcccggtcggcgtgcgccgggccgagccggtcggcgatcaggccggacccgaggtcgcggcgggccagcaggcgggcgccgacggcgacggtcgcgccggtgccgagcagggcgagcaggcccggccaggggtcgtccgccccgtacgggaagatccgctgcacccagccgatcggcgagagccaggagagccggccgagccggccgtcgccctgcgccgagatgtcgccgccgagccgcagcacgtaggagacgcccagggccagcaccgcgatggtgcgggcaccgcgggcgccgctggtcagttgcgccgcgatcgccgcgaccccggcgaacagccagccgctgagggtgaacaccgcgccgaaggcggccgagccggcgaccggcagcccgccgccgatcatcgtcacggtcaccagcacgccgacgatcaggcagccggtcagggtgaccagcagggcggcggcgaacggcgcccaccggccgaccacggtggcccggatcagctcgctgcgcccggcctcctcctcggcccgggtgtgccggatcacggtgagcagggcggccagcccgatcatcaccggaaggaacccggcccgccagaccaccagctcacccatgctgtcgccggacagcggcccgtacagcgcgacgaagccggcgttggccgcgctgaggtgcgcatagttgagccggtcggcgtcggtggcgaacagtttctcgaagccggtgaggtagacccggggcagcaggccgagcagcagcacccagagcggcagaatcacccggtcgcggcgcaggatcagccgcagcagcccgcccagcccggtcatttcccggcctcgtcgtgggcgtagtggcgcaggaacagctcctccagcgacggcggctggctgaccaggctgcgtaccccggccgcgaccagcgaccgcagcgccggttcgagtgcctcggcgtcgacgtcgaaggccacccgcccgtccgcggtgctcaggtcgtgcacgccggcgatcccggccaggccgttgaccgggccggtcagctcggcgcggatcgtggtgcgggtcaggtgccgcaggtcggccagggtgccggtctccacggcgcggcccgcccggatgatcgtcacccggtcgcacagcgcctcgacctcggccaggatgtggctggacagcagcacggtccggtcgccgcgcagtttctcctgcaggatcacctcgcggaacacctcctccatcagcgggtccagcccggaggtcggctcgtccagcagcagcagctcgacgtccgaggcgagggcggcgaccagcgcgaccttctgccggttgcccttggagtaggtgcggctcttcttccgcgggtcgagctggaagcgctcgaccaggtcgtcgcgacgacggcggtcgagcccgccgcgcagccggccgagcaggtcgatcacctcgccgccggtgaggttgggccagaacgtgacgtcgcccggcacgtacgccaggcgccggtgaagtgtcgtcgcgtcggcccacggatcgccgccgagcagccgggcccggccgccgtcgagccgggtcagcccgagcaggattcggatcgcggtggtcttgccggccccgttcggccccaggaatccgtgcacctcaccggtccggacccgcaggtcgagcccgtcgagggcggtgaccttcccgaaccgcttgatcagtccggcggcgtcgatggcctcggtcatggctgctccccttcgtgggtggccagccgatccagtgcttttctcgcctggtcggcctgttccggggtgagcagcggctgctggaagatctccacggcggcgcggatcatccgcagccagccgggcatctcgctgacgctctccccgagcacctcaccgagctgctcgtgcatcaggaacatgcccatcttcatggcggcgacgacggccacgaacgcgcgcgggtcggcgctgtcgatgccggtccgctccagccagaggccaccgcggtcgaccgactccgcgaacatcctcatcccggccggcgagccgtccatcagcgagcgcaccaggtagcgctgcaggctcatggtgtccggcgggagggcgccgatgatccgggtctcggcgaaccggatctgcagctcggcgacgcggctcatggcccactcgtcgcacgcgtcgcgcagcccctccttggagccgaaatggtgccgcaacagcccggaggagaccccggcggcctgcgcgatctcccggatcgtggcgccgtcgatgccccgctcggcgaagagccggatggcggcgtcccggatccgggcccgggcggtcaggtcgctgtcactactcacacgtgtaggctactacacacacgtgtagccacaacaggcatcaattcccgccgttcaccgtcgcctccgtcaccgctcccgaaccgaggttccagcgctgcagcaactcgccgtacgtgccggtccggatcagccgcgcgagggcgccctgcagcgcgtcccgcagcgcggagttgtccttggacacggcgatcccgaacagtcccggctcgtactgcatgtccgaggccagctcgtagtacaggttcgtcttcacctggctgaccaggtacgacgccggcgggaagtcgttgagcacggccaccgcccgcccggtgcgcagccgcaccagcgcatccgcgttggtcttgcgcacgtcgatggtcatcggctccccggcgcagcccttctgccggcgccggagcatgtcctcctggaacgtgccggtctccacggcgatcgtccggccgcacagatcggccaggttccggatgtggtccgggttcccgcgctgcaccaggatcgaggtgccggtgctgaagtagtcgacgaagtccgccttcttctcccgctcggcggtgtcggtcatcgacgagaacaccccgtcgtacgtccccttgtccacctcgtcgatcgcggtggcgaagtcgccggccaccgtctccacccggatgcccagcaccccgccgagcgcggcggagaggtccggctcgaaaccgatgatggtgcgcccgtccgcggcgaaatactccatcggcgcgtagctggcgtcggtcaccaaccggatgaaaccccggttgcgcacggccggtggcagcttggcgcgcaggctgccgtcgacggtcaccgcgccggtgaggtccaggccgctggccgtggtcccggcgtcctccgcggcggcggtgcagccgcccgcggccagcacggccagcaggccggagacggtcagggcacgacggacgacgttcatcgcaggctcctctcggtgatcggttcgacggcgacctgcggccagggcaccgggcggccgtacaggtagccctggccctcgtcgcagccggcctcgacgagccaggcgtggatcgccgtggtctccacgccctcggcggtgacccggctgcccagaccgtgcgccagctcgatcaccgagcggacgatggcctggctctgcggatcgtggtccacgtcggcgacgaacgcccggtccaccttgatctcgctgatcggcagcccgcgcaggtgcgacaggctggtgtacccggtgccgaagtcgtcgaccgagatgccgacaccgagggcgcccagttcccggaccgcccgcaccgcgttgtccgcgtcgccggccagcgcggtctcggtgacctccaggatcagccggtccggccgggcaccggtctcggccagcagcgcggcgacgtagccgacgaagccgggcgcgtccaggttgcgggccgacacgttgaccgacagcgtccagtcccgcccggtggcggtccacccggcctggtcggccagcgcccggcgcagcacccactcggtgagcggcgcgatcagcccggagtgttcggcggccggcaggaactcgccgggcggcagcagcccgcgctccgggtgctgccagcggaccagcgcctccacaccgttgatctcggtgctcggcagaccgaccttgggctggtaccagagcaccagctcgtcgcgttccagcgcgtgccgcagctcggcctggatcttcagccactggtgcgggtgcccggtcgccccgccggcatacaccacgatgtcctcggtgccacgcttgccctgatacatcgcggcgtccgcgcgcatcttcaggtcctgcaggtcggtgccgtgctccgggtacagcgcgacgccgaagctggcctccatgttcagcggcacgccgtcgaggaccagctcctcggcgacccgggcacggatcccggtcagcaccgcgaccgcctgggcgacgtcgcggccgggcagcagcatcgcgaactcgtcgccgccgagccgggccagcaggtcaccctcggccaggccggcgcgcatccgctcggacaccacccgcagcagctcgtcgccggcgtggtggcccagggtgtcgttgacctccttgaaccggttgaggtcgagcagcaccacggcgccgtggccgccgtcgcgggcggccacctcgaggatcgcctcggcgtgccgacggtacgcggcccggttcggcaggccggtcagcatgtcgtggctggcgtgatactcctggcgggcggcataccggccgagtgaccgggtggtccagccggccagcagcgccagcacgaggtagagggcggccagcccgccggccacccgctgggcgaaccgggtcagctgggcccgcatctgggcggcgatcccctggtacggcaggtacaactcaagcaccccgatggcctgcccggaggcgctggcgaccagcggctgcaccacccggatcacctcgctgccgtggtcgccgatcaccttcacccgggactgcccggcggtggcggcccggaaatcgggatcggtggtcggcacgccgccgccggtcgagccgtcgtcggagaacaccacctggccggcgaagccgcgcacccgcagccgcagcaccgacccgttgaacagggccaactgggtggccagccgcatgtcctccagctcggtgccggtcaggccggcattcaggtcggcgccgtcgagcgccggggcgaccgccatctcggcgatcaccgcggcctgggccaggccctgccggcgaccctgctcggcggcgtcccggcggtagccctgccacatcaccgcgcccagcaccatcaccgggatcaggctggcagcggcgtaggtggcgaacaggcgggagctggtccggacgcctgctcgccgtcggactcggcgcaaccgcatgcgggactgatcgacgtcggacggtaccgactgagagtttcaccgcatcccgggtggctgccgcgccgtttgacccggcatgcgtatctctccgcagccgcgactcgtgctcctcgccgccgtcgccctcgtcgcggtgctgctgggctggtcaccggccagggccgcgccggtcggcgcgcggtcgccggagctgccccggttcaacggctcggtctacgcggtcgcgttccgcggcggcatcgtctacgtcggcggcgacttcacggcggcgaccaccgacgggcgccgggtcgggcgacagcggctggccgcgttcgacgcgcgcaccggcgacctgctggactgggcgccgaccgcggaccggacggtgcgggcgctggccgtcgcgggggacgcggtctacgcggccggcgacttcggcacggtgtccggggcggcccgggacgcggtggccatgctcgatgcggactccggcgcggtcggcggcttcgcgcacgagttggacggctatccgcgggcgctggcggtggcgcacggccggctctacctcggtggcgacttcaccgcggtggacggcgcgcagcggacccggctggccgcgttccggatcggcgacggcacgctcgacgacgactggcagccgagtgcggacgcgacggtgtacacgctggccacggcggggcgccgggtgtatctgggcgggagtttccatcgtacgaacgagatgcgctccaccgggcgcctgaccgcggtcgacgccgtcagcggcgacctggtccagggtttccggccgcagccgaccgcggtcgtgtactcggtggcggccgacggccgaggcgtctacgccggtctgggcgggctcggcggccgcgccgaatcgtggaccagcggcggccggctgcgctggtcccgcaccttcgacggggatgtgcaggcggtcgccgcgctggacggcaccgcctacgtcggcggtcacttcgaccgggcctgcaccagtgcgaacgtcgacaagttcggcgactgctcggacgactcccggtcccgggtgaagctggccgcgatcgacgccgacggcgacctgtccgactgggcgccgcaggccaacggcgtgcacggggtccgcgcgatcgccgccagccgggccctcggcgccctcgcggtgggcggcgacttcaccatggtcggtggcgccacccaccaccggatcgccaccttccattgacctcgggcctgtggataaccctgtgggcaacgtgtgtacaaccggtcaggaggccggggccgccccggtcatgatggccaccgcgtccgacatcgagtgcgaggccggcgtgatcaccgcgatccgccggccgagccgctggatgtggatccggtcggccacctcgaacacgtgcggcatgttgtgactgatcaggatcaccggcagcccgcggtcccggacatcccggatcaactgcagcacccggttgccctccttgacgccgagcgccgcggtcggctcgtcgaggatcaccaccttgctgccgaacgccgcggcccgggccaccgccaccgcctgccgctgcccgccggagagtgactcgacggcctgcccgatgttctgcagggtcgccaccccgagctcgctcatgtgccgggcggcctcctcgcgcatcctccgccggtccagcatccggaagatcgatcccagtgggccggcccgccgctcctcgcgcccgaggaacagattgtccgcgatgtccagccccggagcgaccgccaaggtctggtagacggtctcgatcccggccgaccgcgcctccatcgggttgcggaactgcaccggctgcccgtccaggcggatctccccgctgtccgggatcagcgccccggagagcgccttgatcaggctggacttgccggccccgttgtccccgatcacggcgaggatctcgcccggcagcagctccaggtcgctgccgtcgatcgccaccacccgcccgtagcgtttggtcagcccgttcgccgccaagaccggtgtcgtcatgatttgaccttcctgatccactggtccagcgacacggcgaccaggaccagcaggccgatggcgaagccctgccagaccacctcgacgccggccagttgcagcccgttgcggaagacgccgacgatcagcgcgccgatcagcgtcccgatcaccccgccgcgcccgccgaagaggctggtcccgccgagcacgaccgcggtgatcgagtccaggttgtactcggtgccgacgttcgggctggccgaggcgagccgtccgatcaggatccagccgccgaccgcgtagagcagcccggccaccgtgtagaccgagaacagcacccggccggtgcggatgccggcgagccgggccgcctcggcgtcgtcgccggtggcatagacgtgccggccccacgctgtccgccccagcgcgtaatagaaataggcgaagagcaacagcatcaggatggagccgtacgtcagttggaagttcccgatcgcgatggcgtccccggtccacgtcatcaggtgcggcatgtccgatccacggaccgtttcactgttgctgaccaccgagttcagggagaagaagatggtcagcgtgccgagcgtgacgatgaacggcggcagtttgatccgggtgaccagcatcccgttgatcgcgcccatcgcggtgccgcaggccaggcccagcagcagcgcgatcaggccgggcatcccggccttgacgcagaattgcgccatcaggatcgacgagaagaccgcgatcgcccccgctgacaggtcgatgccggcggtcaggatgatcagcgtctgcccgagtgcgagcgtcgcgatcacggtgacctgcagcaggaccagcgacagattcgccgcggcgaagaatcgggtgttcacgatggagaaggcgacgatcgccagaatcaggacggcgagcgggccgagcaccgggttgccgtgcagcgtgtgctgcacccgcagacccagcgaatcatgctttcgtacgtcgaagtcagtggccgtggtcgacatgatgcctttcacccccagcagttctgcttgccccacgcggagtccttggcctccacgccggcctgcgggtcgtcggtgatcagttgcacgccggtgtcgatgaagtccttcccggcggtgttctgcggtttcgtgccgtccttggcgtatttcgcgatcgcctccacgccgagctcggccatcttgatcgggaactgcatcgaggtcgccccgatcacctgtccggcgacgttgtcgacgcccgggcagccgccgtcgatcgagacgatggtgacgtccttctccctgccggccgccttgagcgcctgatacgccccggccgccgccggctcgttgatcgtgtagaccaggttgatcgccggatcccgctgcagcaggttctccatcgccgtccggccgccgtcctcgttgccgtcggtgacgtcgtgcccggcgatgcgcgggtcgttctcgtcgccgatccggttcgggtcgccgaccgggacgccgaatccgtcgaggaagccctggtcacgcttgacgtcgacggagacctggttggggttgaggtcgagcatcgcgatcttcgccggcttgccgtccttggcgaacttcgccttggcccactggccgatcagcttgccggcctggtagttgtcggtggcgaaggtggcgtctgcggcgttcgccgggtcgaccggggtgtccagcgcgatgaccagcatgtgcgctttgtgcgcccggtccagcgacggcacgatggctttcgagtcgttcggggtgatcaggaagcctctggccccgtacgaaataaggttttcgatggcctggacctgcgcctcgttgtcaccgtccaccttgccggcgaaggtctgcaggtcgacaccctgctgctgggcggcgtgctgcgcgccgtgtttcatggtgacgaagaacgggttcgtgtcggtcttggtgatcagcccgaccaccgggtcgcccgagccgcggttgcaggccgcgccggcgagcaccagcgtcacgcaccccgcgaccgccatcagcctgcgcatgttgcctccgctacatcgagggacaacgttgccttggagtagacgcctccggcttccgcggtgtcaacacgatgttgcgcgccgattgcacaaagtgatcgggggtcgccggccggcgacccccgatccggtgcggcgaatttagttgaagctggccagatagaccgggacggtcgcggtgccctgcgccgcggcgccggtgttgttgatgacgtggtcgatcacgccggccccgccgagcgagacggtcagcaggtcgtgcatcctgaccccggagttcaccgggacctcgaagccgttgttcgagtggatggtggagtccgcggtgaagttgcagtaactgcccaggccccacgcctcgtgactggtcaccgagtcggccaccttgtacgcggcgtaaccgttggcgccgctgcgccaggccgcctgggacggcgggtcgtacggctgctcgttctgcaggaagtaggtcctaccgccgttgccgttccacaccacctcatacttctggtaatgctcgacgaacaggccgtacgcggtcacgttctgaccgttcacgatcaggccgctgtcggccgtgttgacggtccagccgtaggtgccggcgttgccgtggtcggcgcgccacgcccagatgtggtcgatgatcgtgttgttgctgttcaccagcaggctgttggtggccttaccggcgatcgagccgccgatccggaagaacacgtcctgcaccgtggtcgggttcgccgcgtggttcgcgctgctcccgttcgggccgatcaccagcaggttcgccgagttggtggtgcccgcgtcgaagagcaggccggccaccttcacaccgtccacatcggccacctgcagcggggtgaccccgttgtccgggatgatggtggcgtagccgaggccgagcaccacggtgttcgcccggttcacggtgatcgtctggttcacgtggtacacacccggctggaagatcaggttcaggccctgcgccagcgcctggttgatcgtcgccgcgctgtcgcccggcttcgccacgtagaactggttcagcgggatgctggtccccggggtgttgccgttcgcccagctcacaccggacgagttggtcgacaggctgggcacgaagacggcgtagtcgctgccgtcgaggtacaggtacggcttctcccggatcaccggggcggtgccgatcgtggtgtacggcgggttcgggaagctctgcgccggggcgccctgcacgccgacgaaggtctggttccacaccgcgttggagttcgagccgatccggctgttgcgggtgaaccactgctgctgcgagtactgaccctcgacgccgctgatccgggtgtcggcgatgtagccgccggacgcccagccgtagccgttcggcgccaggttcaggtcaccgtgtacgtccatccggcggaacggggccgcctgcgagaccgcccaccggtcggcgccggagaccgggtacagcgacatgttctcgaccgagcgccagaagttctgggtggcgttgccgttgaaccagccggcgtccacggtgatgtcaccgttgatccggacatcgtccgggttctgaccgagaccgatcaccgaggtgttgaagccgacctggatgttcaggccgttgtaggtgcccggcttgaacgccagcaggttgcgctgggtgccgaactggttggtctcctgctgcttgaagatcgcatccgcccgggcctggatcgtcgcgctcgacatggtcgggtcgaagacggtgacctgggcgccgaggctgccaccaccgggcagggccggcccgctcggggtggtcgacggggtcggggtgacgacgccaccgccgtacaccttgaactcccacagcgagtagccgtagccggtggtccgctgggtgccgtacatccggacgtagcgaccggaaccgttcaccgtcagcgactggttccccccggtcgaggtggtcgtcgagtagatcggggtccaggcggcggcgttgtccgacacctggatctggaacgccttggcggccgcggtctcccagttcagctcgacccgggtgatcgcctgggtgctgcccaggtcgacctgcagccactgcgggtcggagaacgcggacgaccagcgggtgccggtgttgccgtcgacggcttccgaggcgaggtaggcgccggccgcctcggtcgacgacgcggtcgcgggcctgccctgcgacagcagcgtctcggcagccgatgcgccggtcatggtgatcgcggcataaccggcgacgaccgcggccgtgaggccgacgatcgcgccgctccgccagcgggagcgtctcatgggggtctcctaggtggacgggacgggggaccaggtcttgggagagcgctcacccggccacgacgctaagagtcgttaccaatcgatgtccagaatgttgcgaggttccggaaccggtgacgacccgacccggaaatcgatgtcccgagctggcgaccactacgtttccgcaggccacggtcctgattagaggcgcgtcgacgccccgggccgcgggcgataacacctcttccggaaccggttccgccaagccccgcaacaactcgcaaaaaacctttaacacattattgccgtacgaatcagcagcgtccgtgggagcgccgacgcgcaccgggttcgccgccgatccggcactccggaaagcacgaaacccgccgcggccgggtaggccacgacgggttccgccagtgcggcggggtcagcccaggttgaccgacgggtagagcgggaacggcgagagcagctcggacgcctgcttggagatactttcggagagcgccgggtcgagggtgaacttggccttcgacgtcgggtcgggggtggtgccggccagcacggtgtggatcagctcggcgatctggtccatctcggcgacgccgaggccccggctggtcagggccggggtgccgacccggatgccggaggtgtaccaggcgccgttcgggtcggacggaatggcgttgcggttggtgacgatgccgctgtccagcagcgcctgctcggcctgccgcccggtgagcccgaacgggtgcacgtcgagcagcaccaggtggttgtcggtgccgccggagaccagctggacgccgcgccggcgcagaccctcggccagcgcctggctgttggtgacgatctgctgggcgtacgtcgcgaactccggccgccgcgcctcagcgaacgcgatcgccttggccgccatcacgtgcgggagcgggccgccgaggaccatcgggcagccccggtcgacctgcgaggagagttccggctggcagaacacggcgccgccgcgcgggccgcgcaggctcttgtgggtggtcgtggtgacgatgtgcgcgtgcgggatcgggttgtagtcgccggtaaacacgccacccgcgaccaggccggcgaagtgcgccatgtcgaccatgaaggtcgcgcccaccgcgtcggcgatctcccgcatcttcgcgaagttcaccttgcgggggtacgccgagtagccgccgacgatgaccgtcggcttgaactccttggcggtctccagcagcgcggcatagtcgatctgcccggtggccgggtccaccccgtacgaccgctggtcgaacatcttgccggagatgttgggccggaagccgtgggtgaggtgcccgccggcgtccagcgacatgccgagcagccgctggttgccgaacgcctgccgcagctcggcccactcggcgtcggtcaggtcgttgatctgccgcttctcgaacttcttcaggtacggcacctcgacccggtcggcgaggatcgcccagtacgccaccaggttcgcgtcgatgccggagtgcggctgcacgtacgcgtacggcgccccgaacagcgccttggcgtgctcgacggccaccgactcgacggtgtccacgttctggcagccggcatagaaccggcgcccgatggtgccctcggcgtacttgtcggacagccagttgcccatggcgagcagaacggccggcgaggcgtagttctcgctggcgatcagcttcagcgactcccgctgatcggtcagctccttggcgatcgcgtcggcgatccgcggctccaccgaccggaccacctcgagggcggagcggaatgcaacagattcggcgttgagttcagcgtcagacatgggacctccctatcacgtagtgaagaggcccaggcgcacggcatgtcgtcatctcgacgaggccgctccccgatggtcaaccatccgaacgcgccagtcacggcctgtcccgagcataccggcgcccgccggacccggcacaccgatcaacagcgacgcgggccactgtccggggattggcccccttcgtgggtacaaaaaagaagaggcccacccctgacggggtgggcctcttctgaagttgagtccggcggcgtcctactctcccacaccctcccgagtgcagtaccatcggcgctggagggcttagctaccgggttcggaatgtaaccgggcgtttcccctccgctatgaccaccgaaacagccatcagcagaaccaaccagcaacccgcatcccggaatttcccgggtacggctagctagctagttcaactttacccttacgctttcgtttcgccaaatccgcggtttccctcggatttgccggaaccgaatctcgctcgggccccgcggaaccttacacgacgaagcgtcgcactcgatctcgggggtttggcaggacggccgcggatcttgctgggtaaccccagaagctcgctcgcccgtttccctgccggctcggagaacattacccggtcgcccgcaccgcctccaaaccgaccccccaagtcggggcgggtgatgtggatggtgcggaaatcattcagtgagtaatgaagcgcattcggatagtcaggcccgatgatcgaataccgcccagacgtgcttgctcgcgccccgtcgataccaaccgctgtcccgcgcgaaggtccgcaccagtagcagccccagcccgcccgcaccgaacggccggcgggtgccgaacagcggctcgctcgccggatcaccgtcggacacgtcgagggtcagccgtgccggctcggccagcagccgcaccgtcaccggcgggcagccgtggcgcaatgcgttggtggccagctcggtgccgaccacggccatccgctcgaagagctctccgtcgccgatctccgcccgcagccctctgcggagaacgcgcagctcatcggcgtcacccagggaccactgccggatcagcaccggtgtcatcggtccatcttgccccgtcgagcaggagccgtctcgccgcgtggaccagaagccatattgacgcgcaccacaccgcccgtacgagtgtcactcatactttcggctagtctttcgtcggacactcggctacggtggtcgcagccgaacggacaagcatgttcgagcggcggttcacgccgtcgctcgtgggtagagacgcccgaccgaccgggtccaccacacagtggaccggctctccggaaaggtgccagggaggaccacgcatgaccgtcacacagacttcgacgaccgtcgaccggtcgacggtgaccagcgccgaaagccccgtggacagtgccgcggaactgctcaacgcgatggccgcgatgcccgccgggcacccgtcccgggccgcgctgcgcgaccgggcgatcgaggcctggctgccgctggcccgccacctcgccaaccgctacgccggccgcggcgaaccgaccgacgacctgatccagaccgccaccgtcggcctgatcaaggccgtcgacaagttcgacccggagcgcggcgtcgacttcgccggctacgccatccccaccatcatcggcgagatcaagcgccacttccgcgaccgcacctggtcggtccgcgttccgcgccggctgcaggagctccgcctcgccatcaccgaggccaacgcgaccctgacccactccctcggccgttcgccgacggtgccggacatcgccacccacctcggcatcagcgaggaggaggtgctggagggcctggagggcgcccgcgcctacaacgcgacgtcgctgtccaccccgatcagcgcggacggcaccaccgagctgggcgagacgctgggcggcgaggaccacgagttcgagctggccgagacccgggtggcgctggctccggcgctggccatgctggacgagcgcgagcagcggatcctgacgctgcgcttctacggcaacctgacccagtcgcagatcgccgaccagatcggcatctcccagatgcacgtctcccgcctgctgaccaaggcgctggtgaagctgcgcggccagctggccgccgagacgctctgaggcacgccatgacgatgcccccggctcagcccgggggcatcgtcgtgtcaccgggaaaggtctggtccatgcggccgttgccggtgacgacggctaccgtgtagccgatgccaccttcagccgagcttcccgggttcctccacagcgtcgcgccaattctggaccgctggggatatctggccctcgccggcgtcatcggggtggagagcttcggcgtgccggcccccggtcagacgatcatggtggccgccgcgatctatgccggcgccggccggatgaacatctacgtggtcgccctgatctgtttcgtggccgcggtgctcggcgacaacatcggttactggatcgggttgcgcggcggccgtgcggtggtcaaccggttcgggcgctacatcttcgtcaccccggagcggctggagaaggcggagcagttcttcgcccggcggggcaaccggatcatcgtggtggcccggttcatcgacgggctgcggcagctcaacggcgtgatcgccgggatcacccggatgccgtggcggacgttcctgctgtacaacgcgatcggcgcggcgctctgggtcggctggtggaccacggtgtcgtacctgctgggccagaacctggtgaccatcatcgaccaggcgcaccggtacaagtggccggcgatcgcgctggtggtgctggccgtggcgacctatgtggcgctgcacgtgcggcacatccggcgccggcgcgcccgggccgcggcagcgcagccgcccggcgagaaacccgtgtgaggaaggcggaggcgggtgcgaaggttcagcttcgcgggacgtacctgcgtgatcaccggcgcggccggcggcatcggcgcggcgctcgcgctcgaactggcccgccgccggtcggtgctggtcctggtcgacaaggatgcggagggcctggagcgggtcgccgggctggcgcgtgacctcggcgtttcgggcgtcacgacgtacaccgtcgatctgggtgacggcgaggaccgcctggacctcgcggccgaagtctcgtcgcgcctcggcggcgcggatcttctgatcaacaacgccggcgtcaccctttccggcactttcgagcagaaccggctggccgacgtcgagtggctgctggagatcaacctgcacgcggtgatccggatgaccaaggccttcctgccgcagctgctggcccggccgggttcgcacctggtcaacatctccagcctcttcggcctgatcgctccgccgggccaggtggcctacgcgacgagcaaattcgcggtacgcggtttcaccgagtcgttgcgccacgagctcacgccgcgcggggtcggggtgaccgtggtgcacccgggcggggtgcgcaccggcatcgccctgaacgcgcggctcagtggccccgacccggatggtgagcaggccgcgcagaacaggaacttccacgaacgggcgctgaccctgcccccggaggaggcggcccggcagatcgtcgccgcggtgcagtcccgccgcccgcgtctggtgatcacccgggaggcgcgcgccgctgacctgctggtccggctgttaccggcctcgtactggtcgctcagccagcgggtcgcgcgtcgtttcgactgagatgccggagagcgccggggtgacctgttcgcggagcccgagcatgaccagccactcgatgagctgacggtgcaccgcgtccggcccgtgcaggtccgcggtgatcggccaggcggccgggtggaccagcatcgcgtcggtctgccagccgccgagtccaccgtgcgagccgacgagctcctcgaacgcggccacctcgtcggtctccgggtcgaccgagctgatcaccacgaggtcgcccaggtgcgccgactcctggtgccgcagcaggtcggcgcgcgcgtgacgaccgtacggcaataatggatctttgccgtcgatcttgccgtcgcgcagccggtggctgccaccgggaccgaaagcgatcggcccgtgctcgtcgcccacgatcaccagaccgaccccggggtgtgcggccaggccggcgatcagccgcggataccgctgttcgatctcggcccggagcacccggtgcgggagccgggccagatagaccagcgacaggttcccggaggagagcaccagcagcggggcggcgatcggcgccggatcggactcccggggtgcggcggccggctcgctggtgagccgttccaccacctcgtcgagggtttcgccgtgccgctgccggaaggtggcgccctggctctgcccgtggtcggagagcaccacgaggtggtatcgccgggccgcctcgggcgagagtcgttccagcacgccgagcatccggtccaggctctccagctggcgcatcgactccggccgggccgggccggcgtggtgcgccacctcgtcgtagtcgaccaggtcgcagtagacgaccgggacgccgcgggccatctgctcggcgaccagcgagatgttcacgtcgcgcagcagcatggcggccgggcgcagcgcgaggtaggcgccggagcggctgacccgcggctgcacgttccggcggcgctgcaggcgggcctggtgcagctcggtgaagacctcggcgacgccgaggaccagggcccgggtgaagccgtacggcgaggccatgaacgccgcccagccccgtgccgaccgcccgggcagcgccgcgtgactgatcgtcagcaggttggtgacggcgtccccgccgaacgcgttgctgatgctgaccccgccgtcgcggagcagcccgtgcccgtcgctgagccggcgttcgatcaccgcggcatcccgcggccggttggagaccatcaccttgccggtctccttctcgaaccagcggaacgccgggatctgccgggacgcgccgtgcaggatgccggcctgcgacgccggggtggtcgacggcagcccggtgtgccacggccgcaggctgtggctgccactgcgcagccagttcccgagcaccggcaggttgccggcccggatcgcccagcgcagcaccggctcggccaccccgtcgagctggacgacgagcaggccgggctcggtgccggggcgggggcggcgctagctagctagcggcgggcgctgaggagcgggccgccggcgcggcgggccgcgcggcgccggaccccgcgcatcagccggcgggcctcccggacgaaggtgtcgtcgctgccggcgtcggccatccagtccagcagggccgcgaagatgaccgcgaggatggccgcggtgaccaggctgggcaggccgttgatccggctcgccgggtccagttcgagggcgaccaccatcaccatgacctgggcgatcacgccggacagcatggcgccccagccgcccagcgcggtgatcccgagcagcagcagcgggcgcagcaccgcgcccaccacggcgaccagcaccaccaggccgagcgtgtcgacgatgtcggcgccggccacgccgggcatcagccacagcgtcacggtcaccacgacgaaggtggtgaccgcgctgcgcagcacgccgcgggcccggcccagcactcggcgccaggtgaacagggcacgcacctcggggctcagtggcacgccctcgacgatttcacagccggacacggaccgcgtgtccgcaccctttcggaggagttcggctagcttcgggacggtgcgtgtgcgctcagtactgatgatcccgttcgtcctgatcatggcggcttgtcaagcccccgagaaggcggaccccgccccgcccgtgtcccgggtggtggccggctatttcaccgaatggggcgcctacgggcgcggctaccgggtgaagaatctggtgagcagtggagccgccgggcggctcacccatctgctgtacgccttcggcaaggtggacggtggccggtgcggggtgggcgacccgtacgcggcctacgagaagccgatcgccgcgacggacagcgtcgacggcgcagccgacgcgcccaccgccccgttgcgcggcaacttcgggcagctcaagaagctgaaggcgacccacccggggctgaagatcctgtggtcgttcggcgggtggacgtggtcggccgggttcacccaggcggcccgcgacccggccgcgttcgccaagtcctgccacgacctggtcaccgacccgcgctgggccggcgtgttcgacggcatcgacatcgactgggagtacccgaacgcctgcggtctgcagtgcgacaccagcgggcgcgaggccctggccaaggtgctggccgcgctccgcacggcattcggcgcgggtacgccggtgaccgccgccgtccccggcgacctgaagaagttgcaggcggtcgactactcggcggcggccgcgcaggccacctggctcagtgcgatgacgtacgactatttcggcgccggaaccgccgacaagcagaccgcgccgcattcgccgctgaccggctacccgggcatcccgcgccccggcgcgaccaccgacgcgaccgtgacccagctcctcaaccagggggtgccgccggcgaagctgctgttcggggtcggcttctacgggcggggctggaccggggtgcgcagtcccgcgccgggtgggcgggcgaccggcccggcgcccggcacctacgagaagggcatggaggactaccgggtgctggccgggcgatgcccgccgaccggaacggtgggcggcaccgcgtacgcccgatgcggggtgcagtggtggtcctacgacactccggacaccattcgcgggaaggtcaactatgcgcgcgagcggggactggccggcgtcttcgcctgggagctgtccggtgacaccccggacggccggctgctcaccgccctggccggctgacggtcgctagccgatccggacccagacattgtcgagtacgccgttgaactggtcgttgtcccggaaggcacccttaccgccgatgctcagcggccggtcgttggccacctccagatcggccgggatccgggtccggccgcgcagcacatcgtccacatagatctcgaagcggctgccggcccgctcacaccggacggcatgccagcggccgtcggcggcggtcaccgagctgcgcaccatccggatcaggccggggcgccggacgtcgaccagcacacagctgggcgccccggccatgccgtccacctgcagtttgtactggctgctggttttcgagtagcccttctgcacgacgttctcacccttgctggtctgtccgggtgcgagcaggacgtccgcgccgtacgccagattccgcaatcccgggttgagatccgcggtgccggggctctgcagtgccacgtgcgggcaggggccggtgtcgcagcgggccgggaaggccagggcggtgccggtgccgtggaccacggtgcggatccggccgccgcgggcggtgacgatccgcagcgtgtggccgaagccggaggtgtcccgagtgaggcccggtgcgtcgaagtcgtaccggacgatcatgaccggaaccggcggcggaagcataccgtcagccccggtcagccgaagaagttctgtacctgggtgagcgtcaggtacccctcgtgctccagttcgcggggcaccgaggtgagcggtcgttcggtcaccggcaggtcgccggagccgctcggcgggtccgccggctccgggtccgggggcagcgcgggcagcgccatggcggcccggatcacctcgaacatggtgcgcacctcggacaccgcgcggcgcatcagctcctggtcggtgcaggtcgacgggagcgcgcaggtgaagttggcccgcagctggtcgtcgacgtgccggatgtcggcgctgggccgcaggtggtcgtgaccctcggtgacgatgccgagctggcatccccggatcccgctccggttccaccactgccgccagcgcggatccgcgtccagggtgtgcatggcttgctggagagcgagcaggtagtgccgtggcgcccggccgtcccgagttgccgtccccagccgtgggtggagccagaactcgtccatgtctcgcatggtcccaggcttcccgggcgcctcgtgggaattccgccgtcgcgcgtcggagtggaactcgcctgttccataataggatgatataaattgacggtgcgcatcccggacgaggacgcggccatcgcgaccgctttcgaacatctctacgcgggtctccgccggatcaccccccgggaggagctcagcctcaccgccgcctccaccctggcccggctggaacgctccggcccgcaccggctctgcgagctgcacgcgccggagggcgtcagccaaccggcgatgacccagctggtcacccgtctggagcgggagggcctggccacccggcgcagcgacccggcggacggccgggcggtggtggtgaccatcaccgacgacggccgggcggccgtcacccggcgccgggccgggcgcgcggaggcactctccgacctgctgcgccagctgacggccgaggaccgggcggcgatcaccgccgcgctaccggccctcggccggctgaatgacctgctcacgaaggactgaacgcatgctccccgtcgaccatccgcgctacaagtgggtcgcgctctccaacaccaccctcggcaacctgctcgcgacgatcaactcgtcgatcgtgctgatctcgctgcccgccatcttcaagggcatcaagatcaacccgctggctccgggcaacgtcagctacctgctgtggatgctgatgggctacatgctggtcaccgcggtcctggtggtcaccctcggccggctcggcgacatgtacggccgggtgaagatctacaacgccggcttcgcgatcttcgcggtcgtctcgatcatcctgtcgatcgacccgttcaccggcagcggcggcgcaatctggctgatcggctggcgggtgctgcaggcgatcggcggcgcgatgctgatggccaactcggcggcgatcatcaccgacgccttcccgccccggcagcgcggcatggcgctcggcgtcaacatcgtctcggcgctggccggctcgttcatcggcctggtcgccggcggcgtgctcgccgaatgggactggcgctcggtcttctgggtgaacatcccgctcggcgtgatcggcgcgatctgggcgtaccggtcgctgcacgacaccggggtccgccggcacgccaccatcgactggtggggcaacgccaccttcgcgatcggcctcaccgcggtcctggtcggcatcacctacggcatccagccctacggcgggcacacccagggctggaccaacccgtgggtgctcaccggcctgatcggcggcgccgtcgtgctgatcatcttcgggatcatcgagacccgggtcgccgaaccgatgttccccctcaagctgttccgcaacgccgccttcaccggcggcaacgtcgccaacctgctggccagcgtcgcccgcggcggcctgcagttcatgctgatcatctggctgcagggcatctggctgccgctgcacggctacgactacgagcgcaccccgctctgggccggcatcttcctggtcccgatgaccatcggcttcctggccgccggcccgctctccggtttcctctccgaccggtacggcgcccgcccgttcgccgcgggcggcctgctcgtgatggccgcgtccttcgccggtctgctgctcatccccggcgacttcagctacccggtcttcgccctgctgatcttcatcaacggcctgggcggcggcctgttctccgcacccaacacgtcgctgctgatgtccacggtcccggccaacatgcgcggcgccgcctccgggatgcgggccaccttcatgaacgccgggcaggtgctctccatcggcgtgttcttctcgctgatggtggccgggctcgccgactccctgccggccagcctgcacgccgggctgaccgcccagggcgttccggccgacgtcgcgacccgggccgccggcctgcccccggtcggcaccctgttcgcggcgttcctcggctacaacccgatcgccgaactcctcggcccgcagaccctggccgcgctcccggccggcaacgcgcagaacctgaccggcctggaattcttcccccggctgatcgccgaccccttccacgacggcctggtcgtcgtcttctggatggcgatcggcatggccgtgctcggcgcgctggcctcgctgatccgccctcagcccgaatcgagcctgcccaccgacggcgccgccgacggccccgacctggtggcgcacgaggccgaactcagcgctgaactcgccgaagcccagccgctccagccggcgacccggatgccggaaccgcgggaagaccccgcgacccgggactgacctccccacgacgacggcacctcccaccgggaggtgccgtcgtcgcatgccgggtcaggtgcgttcctccgggcggatcggcacggagtcgcccttgcggccgaagagtttccagccacgcttcttcttctccaccaccggggccgcgtcgccgttcaggatgtccaggcgctggcgggccaccggattgttcggttccagccgcagcgaggtggtcaacgcctgccgggcctggtccacgtgccccaacgcggccagcgccaccccgtgcgtgaagtagtagtgggcttcgttcgggtccagcccgatcgccgtacgcgccgcctgttccgcgtcggccagctgccggtccgcggcgagcagcgcccacgccacccggtcgtgccagagggggttcttgggttcgacgatgaccgcgcggtacgccatcgacatcgcctcgtcgtgcttgccctgcagggtcagggcgcggctggcgatggccagcggacgcggatcctcgggcgcctgctcgatcgcccggtgcgcggcggcgaacgccggttccacctggtcgagggccagccggatgcgggccatcaggatccatccggcgggtgactccggattggccgcgagcaccggttccagcgccgcggcggcctcggccggctgcatgttctcgaacagtgcggcggcccgggcgatcgccgggtcggccgggtcggcgaacggacgctcggcggccccgggatacgggggtggtgcggttggtgccaggtcggtcatcgggccgctccgggtagccaggggacggggctcacaaggctcacttcggcgggcggcgacgatttcttaagttaacggtcaggctcaacagccggacgatgaaaccggcgaggcaggcgaggccgagcagggccggcagccaggcggccggcgcgacggtcgcggtgagcagcagggcgagggtcacggccgcggcgacgctcgcggcccgatgccgattgacgacctcccggaggtacgttttcagcacccggtccagccgggcgacgaaatagctcgcgtacgccgcgggcaccaggaaagccgcgccggcgagcacccgggcccacggggcggactcccccgccacgcgccacccgaggtaggcgaacacccccatcatgaccgccgcgtacgtcaggaactgtcgcagcgcggcgtccagcagatgccggctcgcctcctgacgcggatccgcccgcagtgccgccaccagcccggtcaccccgcgggccagccggcgcagcgcgaacgggttgcggtgcaccacgtcgaaagcggccagttcgtgccgggcgatcgcattgtccggcgcgatccgcaacgcgtcccgcaacgcctcccgcgcgcgctccggcagattcaactgcttcatgaccatggcgtacgtgatccggaagtccgcctcgtccgggtcgagccgcaccgcctcgcgggcggcgtgttccgcctcgaccggccgcagaccctgttcgagcagcgcccaggcgagccggttgtgccggtacgggttctccggctgccgagccgtcgccgcctgcgccgtcgcgatcgcctcgtcgtgccgccccagcgcggtcagggtgcggctgagcgcggtcagcgcctccgccgaaccgggcgcgtaccgcaccgcccgggccgcgacctcgtgcgccaggtccggtttctccagcgcgagctgcgcgtgggtcatcaggaccagcgcggtcacgtggtcgggttcggcggccagcaccggccccagcagttcggcggccgcttgcgcctcgccccgctgcaactgcaggcgggccatcgcgatcggctgggcggtggtcacccctgctcccgcggcccgggcacgatcgggacggtggcgaacgcgcggaccgggaacgtgccgaagccggccagccggggcggcaccgcggtgaactgggcgccgtgcaccggcagggccgccaggttggtcaggtgttcgacgatcgggatcccggcggccagcagcaggctgtgcgccgggcgttcgccgcgggcctcggcggagatgtcgtcgatgttgaccgcgtcgatgccgaccagcaccgcgccgccgtcgaccagggcccgcgcggcctccccggtcagatagggcgcgtcgaccgcgtagtcccgggtggcccagtgccggtcgccgccggtgtgcagcagcaccgcgtgaccggccaccggcaggccggccacctgggcggcggtgatcccgcgcgccgggccgccggccgcgcgcaccacgaccgtgggcaggccggccagccgctccaggggcaggccggccaggtcggtgccgtcggcgtaccggtggaaggggctgtccagatacgtcccggtgttgccgaccatggtgatccggtcgatggcgaactcggtgcccggcgcgtaccggtcccgggactcgacgcgactcaggtgctcggcgtaccgcggggcgggcaggcccggataggtgaccatgccgtcccggatcacgtggctgagctcgacgaaccgaaccatcggccgctccctcccctatgaaaggccgacgacaccctcgacgatcagccagatgccgaagatagcgaacagtgccgcggcgccccacttgatgatgtgctccggcaggtgccggccgagcagccggcccaccaggatcgcgagcgcgtccgcggccaccatgccgatcgtcgaaccgacccaggtgccgaaccagccgtgctgggtggccagcgtgatcgtcgccagcatcgtcttgtcgccgagctcggcgaggaagaacgcgccaccgacggcgaggatcgcggaaccggtcgagcgttccgccttcgacttctcctcgtcggtgagcttgtcgccgcgcagtgtccaggcgccgaacgcgaggaacgcgatacccgccaccagcgagatccagtgggtgggcagggccgcgccgagaccgtagccgatgccgaccgagaccaggtggaccagggcggtggccacggtgatcccgatcagcaccggcaacggccggaaacgggtggcgaaggtcatcgccatgagctgtgacttgtcgccgagctcggcgacgaagatgaccgcgaaactgagacccagcgcggcggcgaaacctgacatgagaactcccggtgagcacacgaccgggtgttgggcgcaggacgacctcgacccggccgcctggtgatggacagcctggtcgaaggtctcgctcgcctcagtgtcgcaaggccgcgcggccggacgccggaacgtcagtatgtcgaccgcgacattgggagctactccccttcgcgtggcccagcatagctgacgccccggcggcgccctaccgcctgttgatcagctgctggagccggaggcggtccgacagctgcccggagcgctgcaacggcggcttgcccggcgtcggcggctgcagcggcttgcactgcttgtccgagtggttgccggacacccgggccggcagcgccccggtgcccagataggcggcgaccgtgtcgtcgacacacgagtcaccgaacagcgacccggcgtgcgtcgtcccgttcacgccctcgaccagcacggaccgggggaagatccgtcgaacctccagacttcccgtgtacggggtggccgcgtccagcgtctcgctgagcagcagaatcggcggggccttgctgccgtccacccgcaccggccggtccggtttcgccgcccagtgccggcacggcgcgttgtaccaggcgttgccccaggtctcgaacggcgcctggtggtacaccttccagttgtcctgggaccagtccgcccacttcgccggccacggcgcgtcggtgcactgcacggccaggtagaccgcgtagttgttgtcggcgcccgccgtctgggggttgttgtcgtcgtagagcttcttcagtccggccggatccttcttgacgacccagttggagaaggcgcgtcccaccgactcccagccgaagatgtagtagcccggctgcaggaagatgtcggtcagttcggccggcccgatcaccccgccggccggtttcctggtcagctcggcgagctgccggtaatacagcgcctcgacgtccttggcggtccgccccaggtggtaggacttgtcgttcttcgccagccacccgaagtagatcttgatgttccggtcgaaggcgatgtcctggtcgatgttcgactggtaccagactcgggtcgggttgacgttcccgtccaggaccatccggcgcacccggtccgggaactgggtggcgtaaacctggcccagataggtcccgtacgagaagccgtagaagttgattttgtcggcgccgagcgctttacggatgctgtccatgtcccgcaccgagtcctcggtgcgcatgtgatccagcagcggcccgcccgccttggcgcagtccgcggcatacttcgtggcccgccgatgccaggagtcctccagcgccgcggtcaccggcacgtaggccggccggcgatagccggcataggcactgtcacaggtcagcttcggcttgctggcccccacgccgcgcggatcgaacccgatccagtcgtaggcgtccccgacgtcgttgggcaccttcgcgccgagcgtcgccatgccccgccccgcaccccccgggccgcccgggttgaccagcatcaccccttgatactgagcggccggaacggtgtgcttgacccgggccaccgccagctcgatcttggtcccgcccggattgtcgtaatccatcggcacgctgaccatgccgcattcggctccttgagccttcagcgacaactccgtacaggcattccagacaatcgcggtcggtgtgtagttcggcgtcccccgccgcagacccgccaccccaccacccgcagcgccgcctggctgcgccgcagttccatcgcctacagcgccgcccagcgaagcagccgacccgccgctcgcagcaccacccggcgaagcagccgacccgccgctcgcagcaccacccggcgaagcagccgacccgccgctcgcagcgccgcccgacgaagcagccgacccgccgctcgcagcgccgcccgacgaggtcacctgcttgtttcccgccacgccatcaggcgaagccgcctgcccgccattcggcgcgccgtgcggcagagcggcctgcgcagaggtggtcgcggtgccggccgcaccgagcgcgaccacaatggcggccgcccagattctcttcattccctcgcccctcgatgtccgtttcgccccatatgctgagccgtcgtaggggcacccacacccgtccacgccgagacggacacgaaagggttgatcagccgacgcggtcggcagcaccggtcagcaaccggccgcccaaccccggaaccaccgaaacagcgcagacccggccgccccctgcgcgccacccgggcagctcacagcaccggctgagctgcccggtcagcccggcgcccacccggaacccaccgcgaccgcagaatcgacggcaaacacacagacccatcgcgagcacaggttcttcccgacgagccgcaggactggaccgaggcgcgagcccgagccgagcccacgccgaaccgagccgatgcccgtggccgaaccgacgcccggagccgaaccgacgcccggagccgaaccgacgcccggagccgaaccgacgcccggagccgaaccgacgcccggagccgaaccgacgcccggagccgaaccgacgcccggagccgaaccgacgcccggagccgaatcagggcctgggccgaaccaaggccggggccgccggacccaggccgcaccagacagaagcgaggcctggggcgcggtgggtcaggcgcgacactgggccgcgggtgtgtcagggcgcagcaccgggctgctggtgtgtcaaggcgcagcaccgggccgcggtgtgtcaaggcgcagcaccgggccgcgggtgtgtcaggcgcgggagcgggagcgcaggcgctgggcgacgagggcgagtagggccagggcggcgacgatggcggcgtaccacagggcggtgatgtgcaggccgatgtgggtggcggtctggccggcgatgaccgcggggatgctgagggcggcgtaggagatcgtcaacgccacggccaggagctcgccgcgctcgtggggctcggcgatgcgggcgagcgtgctgaacgaagccagcgcggcggcgccgaagccggcgccggagatgatcgagccgatcacggccaggggcaggctgccggtttcgaggccggcgaaccccagcgcgccgccgaggagcaagccggacccggcgatcgtcaggactcgcggtgtggccacctgacgcagcaggaatgatgtgaccgctccggtgccgcagaccagtgccaccacaaggcccccggccaggtggtcgtggatgccgaacgagtcggacgcgaccgacggaccgagcgagagatagagcccaccgagcgcccagctggccacgatgatcgggatcagcgcgaacaggtcaccgcgcagccgggccgggacgccgagccgcgggatcagggacgcggccgcgccggggcgccggccggacgtctccggcatccaggccaccgcgagggcggcgacgaccatgccggccagcagcaacgcatagaccaggtgagtggggaacggcgcgaatttcaccagcactccgcagccgaacgcgccgatgcccagcccggcgaccggcgcgatgccgctgatcagaccggcccggccgggagcgtgcgccgggttgaggtcgatcagggtggcgcccagcgtgctgagcgccgcgccggtggcaaccccctgcaccacccgggcggccagcagggtgccgacgtcgccggcagtcaggaacagggtgagcgcgaccgcctccagcaggatcgcgccggccagcaccgggcggcggccgatgtagtcggacagcgcgccgagggtgagcagggtggcgatcagggcgaccacgtagacggcgaagaccaccgtgagcatcgccggggagaagccccagagatgctgatagacgacgtagagcggggacgggacggcggacgccgccgcgaatgtcaccaggatggcggcgatcgcggtgaacgcggcgggccggctcaggcgggccgggacgaccgtcggggcgggctgtcgtgcggttgcggtggtcatgggtttcccccagtgattgaacagacaggtctgtctgcttgctggacctgacactagacaggtctgtctgttaccgtcaatcgcatgtcagttgggtcacctcgccggtcaccgcgccagtcggtgcgggagcgcctgctcgccgccgctgacgagctgttctatgccgagggcgtgcacaccgtcggcatcgatcgggtgatcgagcaggccggcgtcgccaaggcttcgctctacaccgtgttcgggaacaaggacggcctggtccgggcctatctgcacggccggcacgagcagcgccgcgaccggatcatgcggcatgtcgatcagcacaccgacactcgcggccgcctgctcgccgtcttcgactcgctggccgaggcggcggaggttcccggcttccgcggctgcgccttctacaacgccggcgccgaggccgatccgaacggggtcgtccgcgaggaggccaccgccaaccgcgcctggacccgccagctcctcaccaggctcgccgccgaggcggacgcccccgatccggacgctctcgccgcccagttggtcgtcctctacgacggcgccaccgtcggcgcccgccaggacggtcccgccgccgccaagaccgctcgcacgctcgccgaaaccctcctggaggcaaccctcccccattgacttctttccgcggtacgcgtgagcccaccccgccgcgagcagcatcccgccgagcgtgggcgcattggggcgcacgagcgcacggatgcccaggtgcacgagcgcgcgggtgcgcggggcgcgcggggtgcatgagcgcgcggggcgcgcggggctagctagctagggggcgcatgagcgcactgggtgcgcgggtgcgcaacaggagcgctcagatgcgcggggcacggatcactgagtgagcgcggccccacgatgcgcgctgcgcgactccgggcgcggcgaagcggctattcggccctggcccggcgccggagcaggagccagacgagccatccggcgccgatgatgaagacgaagctgatggcccggtaaaggaccaccgcggcgatggcgctcgcgctggtcagcccaccggccacgagtcccaggatcagggccgcgtcgacgacaccgagcccgccggggatcaccggcacgctggccgccgccatccccgcgcagtaggcgatcagcaggtgcaccggcgtgatccggtccgccccgaccgcgatgcagcagacccacaggcagagcgcgtcgaagagccagttggcgcaggccagcagtaccgcgacgaggaagtggaccgggtggacccggatcgcccgcagctgggtgacgaagccgaacagccggtccgccccgtgttccggcggccggcgccggaccttgttgacgctgccgagcagcgcgcgcaccggccggtcgagccacagcgggtgtttggcgagcagccggacggcggcggtgaccgcgatcgcgccgagggcatatccggcgaggctgcgccagcttccggtgttccgggcgaggaggccgccgaccgagccgaccaggatcagcgcgccggtggacaggacaccgctgagggcgatgcaccaggacgcttcggcgggggtcacgccgtaccgccgcatttgccggaagttaaagcttgtggagaaaaccgggccaccggggagtgtcacgctcagtgagtgggccgcataggccatcgcgacgtgccgacggacgctgaccttcttgccggcgccgcgcagcagcgcccgttgcatccgggcgtaggtgcccatcgacacgatctcggcggccagggccgcgccgacccacccccagtgtggtgcgcggagctggccgatcgcgccgctcagcgcgggccagccgatgatcagctcggtgccgagaatgatcaccatcacggcggccaccaccggcccccggcgccaacggcgtggcgggccggcagccgacgtggcagccgccggggcgccggtcgcggtcatctctccgatcgtcgcaccggcgtgagcacttcgcgcatctttcccgcagacggttggtgccggtggcaggctgttcggcatgccccgcccccggattctcatcgtcggcgccggcttcgccggtcacgccgcggcccgccggctggcccggatcgccggcggtcgcgccgagatcgtactgctcaatccgaccgactacttcctctatctgccgctgttgccggaggtcgcgaccggcctgctggagccgcgccgggtgtcggtgccgctggcccgggacggggtccgggtggtcctcgggcatgccggctcgttcgatctggatgcccggaccgtggagtgggccgatccggagggccgccgtggggtgctcggctaccaccggctggtgctggcgctgggcagtgtgaacaggctgttgccaatcccgggcgtgaccgaatacgcccacggcttccggggtctggccgaggcgctctacctgcgcgaccacctgatccggcagatcgagctggccgcccagtccagcgatccggtggagcggcgtgcccggtgcacgttcgtggtggccggcgccggctacaccgggaccgaggtgacggcgcagggcgcgctgttcacggccgcgctggcggcgtcccggcccctgatccgcgacctgccgcgctggctgattctggacaccgccgaccgggtgttgccgacgctggatccgcggctgtcgcacaccgccgcggacgtgctgcggcggcgcggggtgcgggtgctgaccggggcctcggtccaggaggccggcgcggacggcgttcggctcagcaccggcgagaagatcctcaccaggaccctggtctggtgtgtcggggtgcgcccggaaccgctggtcaccggcctgggcctggccacccgggagggccggctggtcgtcgacgagttcctcaacgtgccgggccgcccggacgtgttcgcctgcggggacgcggccgcggtgccggatgtgctgcggcccggctcgctgaccgggatgaccgcgcagcacgcggtacggcagggccggctggtggcgggcaacatcgcggcgtcgtacgggcaggggcggcgacgcccgtaccgccatcgggatctcggtttcaccgtggatctcggcggctgggcggcggccgccaacccgttcggagtgccgctgagcggggtggtggccaaggcgatgaccaggggttatcacctggcggcgatgcccgggaaccgggtccgggtgacggccgactgggcgctggacgcggccctgtcccgccagccggtgcagttgggcatggtccgcggcagcgcggttccgctccgcggttgacgccacccgcgctggggacggcctcaacggttgacgcgttccggccggtgcgcgccggggtcccgctgcttcgggatctgcacggcggtctgcggggtcaccaccagtgcggcgccgcccagcccgatgccggcgtacaccaccggccgcaccgaccgaagcaccagcgcatgaccgatgccgatcgcgaggcacaccgccagcccgccgagcacccacccggccgccggccctcccccgaccagcgccggcaggtcgagcaccgcgagatggaccagcaccccgaggaacacggtggacagaaggggcgcgaggaagcgggcccagatcccctcggtagccggctcccggttcaggtgcagcagcgccgccagcgcggtgagcagcaacaacaccaggatggcgagcccgccgccgaccgtcagccagcgtgcggtgcgggccgaggtttccgcgccggccaggtaggcgccggtcgaggccgcccccgcgacgagggtctgggtcagcgaggcggcgcgcggcgcgccggtccgtggcgagagatcggcgagtacgccgggcagcaccccctcccggcccagggcgaacaggtatcgggcgatcgcgtggtgcaccgccatgatcgcggcaagcaggccggccaccagcgccagccggccgagcgtcaccgcccacggcgccacccgctcgtcggccagcgcgaacagcagctccgggccgcgcgcggcggcccggccggcgaccccgcgcggcccggccgtaacgatcatgctccaggtcacgccggccagcagcacggtgagcagcccgatcgccagccgggcggcgcggccggcggtgcggtgccggttgcgggcctcctcggcgtatccggcggtggattcgaagccggcgaaggcgagcaccgcgacgacgagcagcacgccgagcagcggccgaccgacccgggacagctcgccgggcaggtaggtgccggtctcgatccggccgccggccggacgcagcaggttggcggcggccagcccggtcagcaccgcggcctcggtgacggtgaggacggcgagcaccgcggcggcgaactcgatgcgcagcatgccgcaccacccgaccagcgcccagcccgcggcggtcaccgcccaccagggggcggtcagtccgaaccagctgtgcagcaccggggctgcggcctgcccgagcatcgcgtagagaccgaattggatcgcgtggtacccggccagggccagccagccgccggtgaccgcgacggggcggccgagaccgcgggcgagctgcggatacaccgctccggcgctgggtcggcggcgaatcatggtggcgtacggcgtacccaaaatcaacaggacgatcgcgacggcgacgacggcgagtgcggcgagcggaccggcgccgacggccaggaccggcgggatcaccgtgaccaccgtgacgatcggcgcggcggcggcgacgccgaagaaggcggcggagccggcacccaggcggccggccgccaggtgcgctggtgcgggatcgtcggggtccgagggttcgtcaggggtgcccacggactctattcaggcgcaccgaagcggactttgacaaccatacgtgaccagacaatgaccgctcgtgaccagattggcacaccgccttgaccgggtggcaaatcctcaactgggcgggttgccggccgacagcaatcatgtgctcgccacccagcagctgacggagtttctcgccgtcgtcgccgaccggcccgacgaggccgccgcccagcatgccgccgtcgaatgcgcgatgcgtgcgctcgacgccgacctcgccgtgctgatggtcgacggcggcgtcgcggccgcggtcggcttgcccgtcgtcccggcgtacgccttggccgaggccgccgcgggccgccgggccagcctcgacatcgacggccgggtgtacgcggtaaccctcgcccacctgggcggactcgccccgggcgtcctggtgctcggccgtgagacgccgttcagcatcgaagaggtgtgcctgctccgcggcatggcccgggttctggagctgagcctgcaggcgctgcacctcatcgaggcggaacgccggcaggcggccgagaacgatcggctgatcaactccttgcagcggcgccagcgcctgttcgaggagctcagctcggtacagcgggcgatcgcccggcgcgagccgctgcgccggatcctcgaccagatcgtggcgagcgcggccgacctgctcgacgtggaaatggccgggctgaccgtgctcgacctcgacgatccgagccggaccagcctgatcgccagccagggcgtgcccgaggagggcgtccagcggatgcagtcggtgccggtcgccgcgctcggcgccgccggcctcgcgatcatgggtgatgagctggtcgcgatcgacgactacgcgaactcaccgatcgcggtgccggagatcgtccgggcccggctcaagagtgtggcggctgtgccggtgcacgaggacggggtggtcgtcggcgcgatgttcgtcggctcgttcaccgccgtacgtcactgggatcgtgcttcccaggaaatcttgcaggccttcgccgagcacatcagcctggccatcaccgacgcgcgcacgctgcgcgagatgagccacgccttccacgattcactgaccgggctcgccaaccggaccctgttcaccacccggatggagaacgcgctggccaccgtcggcgccggcggggtgaccgcgctgctggtcgatctggatcggttcaaggtggtcaacgactcgctcgggcacgcggccggcgaccggctgctcgccggcgtcgccgaccggctgcgcgactgcctgcgcaccggcgacaccgcggcccggctcggcggtgacgagttcgccgtgctcatccccggcgtggtcggctcggaagccgcggtgccggtcgcccggcggatcgtggccgccctgcgtgaaccgttcgacctcgacgggcgcgaagtcttcgccagctgcagcgtcggcgtggcctgggccgaggtcggtgaaaccgatgccgacgacctgctggtccgcgccgacctggcgatgttcgaggcgaagaagctcggcaaggaccagtacgcgatcttcgagccggcgatgcgcgaatcgttccagaagcacctgcagatggaggcggacctgcgccgggcggtgctgcggcacgagttcgagctgcggttccagccgatcgtgcggctgcgcaccgaggagatctccgggctggaggcgctggtccgctggcagcatccggaccggggcatgattccgccgctggagttcatcccgctcgccgaggagaccgggctgatcgtgccgatcggcgaatgggtgctgcgggaggcctgccggcaggcggcccggtggaatacgcagcgctccgggcaggcgccgctgacggtcagcgtcaacctgtccgcagtccagctggaacgcgcggacctgccgcaactggtggcggccgcgctggccgacagcgggctgccggcgaaatgcctgatcatcgagttgaccgaatccctactggtggaccaccggccggagacgctgcggcggctcgaggagatcaaggaattgggggtacgcctggccatcgacgatttcggtaccggctactcgtctctcgcctacctgcgtaaattcccggtggacatcatcaagatcgacaagtcgttcgtggacgacatcggcgacatgccggccgcggcggccctcacgctggggatcatccagttggggcaggcgttgcagctgtccacggtcgccgaggggatcgaacacgtgggtcagctcagcgagttggccggcgggaactgcgagctcggccagggttactacttcgccgaaccgctgaccgccgcggcgatggacgacctcctcttcccggcggaggcaccgccggcgagtgagcagaccactgctcacggtgagtaagcatcccgggtttccacgccgcaagatcgtcgcctacagtggacgctgaaaccgctgaggcagaggtcaacgggcatttacatcgcctgttccaggacgtttcacacgatctgaggatctgccccaagcgcccggatccggccggggaggacgccgccacgtccccccggccgcccgcgctccgcaccgcgacgcgatagcgttcccgctgtggatctcgacatcgaccgccgagccgtcgccgtcgtctccgccggcggcatcatcggcgccctgacccgctacgcgatcggcaccgcctggccgcacacccccagcgacttcccctggtccacctgggtgatcaacacctccggctgtttcctgatcggcgtgctcttcaccctgctggcccgcttccgtccaggtcaccgcctcacccgccttttcctgggcacgggcgtcctcggcggctacacgacgttctccaccgccgaggtggacgtcctgcggaccacgccggccatcgccgtgctctacctcggcgccacgatcaccgcggccctgctcgctgtctggatcggcagtgccctcgcctccgtgcccaagggcgccggccggtgaccgtgctgctggtggcgatcggcgcggcgatcggtgcccccctccgctacgtcaccgaccgctacctccaggtccgctacggcaccgctttcccgtggggcaccctcacggtcaacgtcaccggctcgctgatcctcggcttcgtgctcggcatgccgctgtcccccaccgcgaccgccctgctcggcaccggtttctgcggcgcactcaccacctattccacattctcgtgggagaccctcaccctcacccgccgcggcgaacaggcatccgccctcggctacgtcctgctgagcctgctgtccggcatgggcgccgccaccctcggcaccctcctcgcccgagcactctgaacgaacctcagcacttcctgaacgaacctcagcacttcctcgcctgagcactctgaacgaaccccagcacttcctctcccgagcactcggcaaggaacgacgcagcggtccggacccaccgcgggcccggaccgcctcatcggaacctcagcccaccggcgccagcgcccgcggctcgtcctccgtctccgccaccggcggcacatcgtgcgcgatctccggcagccaccccagccaccgcggcagccaccagttggcccgccccagcagcgccatcaccgccggcaacagcaccgcccggacgatcgtcgcgtccagcaggacggccgccgccaggcccaccccgagctccttggtcgaggtcagcggcagggtcgcgaagagcgcgaacaccgccatcatcaccaccgccgcgctggtgatcaccccggccgtgcgcccgacgccctcgcggatcgcctcccgggtcggcagcccccgatcgtggccctcgcggatccggctgagcacgaacacgtggtagtccatcgagagcccgaacaggatcacgaacaggaacagcgggatccagttgatgatcccgtccgagggcaggaagccgagctgcttgtcgaagtgcccgtactggaagacgaagaccagcatcccgtacgccgcggccaccgacagcaggttcagcaccaccccggtgatcgccacgacgaccgagcggaacgacaccagcaggagcacgaaggccagtccgagcacgaacccgaagacccacggcaggctcttctgcatctggtggttgaagtcggcgttgcccgccgcatcaccgctgaccaggacggtcgcgccggtgagcccaccgaaggcggccggcacgacctggccgcggagcagtttcagcgcgtcggtcgaggctttgttctccccgttgccgaccagtccgacggagacgaccgccaccgtgccggccgggttgacccgcacgtcgatcggctcgacgagccggccgccgctgcggccgacggccgtcttgaagtcggccaccgccctgtcgaaccgctccccgcgaacggtcgaggcctgcaccaccacctgtgccgggctggtcttgctggggaacgcctcgttgatcgcctggaacgcctggaccaccggcgccttgggagagatgtccagaatgttctgtccccgggtccgcatgtcgacgaccggcgcggccagtgcgcccagcagtcccaccgcgaccagcgtggagatcagcgggcgggcgagcacgacccgcagcatcgcgttccacatccggccgtcgctgcgccgccggtacaggccggggatcttgatggcgtcgacccggtcgccgagcgccgagagcagcgccggcagcacggtgagcgagccgagcaccgcggtcgcgaccaccaggatggtgccgaggccgaagctgatgaacgtggtgtcccgggtgaggaacatgccggccatcgccacgatcacggtgagaccggagatccagatagaccggccggaggtctgcgcggcgatcatcagggcccgctcgggatcggctccggcacggcgctcgtcacgctcgcggcggatgtagaacaggcagtagtcgaccccgaccgcgagcccgaccagcagcatcacgtgcgtcgtcgcgtcgaccgtgtgggcgaaccggctgccggcggccatcagcccgatcgccgcgatcaccgcggtcacggcgagcccgaccggcagcagcgccgccaccaccgcgccgaaggcgaccagcaggatgcccagggtgaccgggatcgacatcatcgagagccgggacagccccgcgtccagctcgtcgccgatcagcttgtcgccgctggcgtcaccggcctcggcgacgtagaggtcggggtgcgcggtctgcacctgggcgaccgcgtcgagcgccggcccgacccgctccttggcggtctccgggtccccggtgatgctgaagctgaccagcgtcgaccggccgtccggcgactggatggccggctgcacgtcggtcacgtcgtgcaacgacttcagcgtgcgggtcacctcggcggcggcggccgcccggtcgctgccggaccggttctggatcagcaccatctcgcccgccggctggaccgggaagccggccgcctcgacgatcttgtcggcccggccggaatcgccgctgccctgctcggcgccggtggcctggcgggtgccgagctgtccgctcaggacgaccgtggcggccacgaaggcgatccacccgagaatggcgagcacccggtgccgggcactccagatcgcggcgcgtgccgcgattcccttgactttccccctgtgctccatgacgagaacgctatggatcacggagatcgatctcgaccaggctggcccccgacctgagggtagggctagccctacgtctgcaggtaggccagcaccgccaggacccggcggtgctgctcctcgtcctggtgcagatcgagcttggtgaagatgttgcgcacgtgcttctcgaccgcgccctcggtgaccaccatcttgcgggcgaccgcggtgttcgacatgccctcggccatcaggcccagcacctcacgctcgcgcggggtgaggctgcgcagcggatcgtcacgccggcgccggaccagcagctggccgaccacctcggggtcgagcacggtgccgccctcggcgacccggcgcaggccgtccaggaagtcggcgaccagcgacacccggtccttcaacagatagccgaccgcgccacggcggtcggccaggaggtcatcggcgtaggagacctcgacgtactgcgaaagcaccaggatcggcgtgcccggaacccggctgcgggcctcgaccgccgcccgcaggccctcgtcggtgtgcgacggcggcatccggacgtccacgatggagacgtccggacggtgttccaccacggcttcgacgagggacggcccgtcgccgacggccgccaccaccgtgtggccgttctcctcgacgagccggatcagtccctcgcgcaacagcaccgcatcgtcggcaatcaccacccgcatgcggtcactctgtcagagcggcagggcggctgtcaggcgggttccctccccgtcggcgctgtcgacggcgagcacgccgccggccgcggtcacccggtcgtcgaggccggccaggccgtgacccttggccagactcgcgccgcccaccccgtcgtcggaaacggtcaccagcagaccggtggcgatccgctgcacactcacctgcacctcggtggcgtcgctgtgcttggccacgttggtcagcgcctcggcgaccacgaagtacgccgtcgactcgaccgccgggtccagccgctcgaagaccggcgcgtccaggtccaccgggacggtgcagcgaccggccagcgcggtcagcgcggcctgcagaccccggtcgaccaggatcggcggggcgatgccgcgggacagcgcgcgcagctcgtcgagggtttcccgggtctggctgagcgcctcggcgacggtcgcccgggcggcttccgggtcggtggcgaactgctgctcggcccggcccaggtccatggcgagccggaccagccgctgctgcgggccgtcgtggatgtcccgctccagccggcgcagcgcggtcgcctcggccgagacggccgcggctttctggtgctgggcgacgtcgcgggcggcgttcgcatcggccacctgctggcgcagctcgtcgaccccgctgagcaggccccgggcgaacagggcctcgagcagcgccgcgccgcgcaccaccgggtacagggtgagcgtgaagaacgcgccgaggatcaggtagaagatgatccgggtgggcgcgttgtcggcgaagcccagcagctcgggcagttcggtgttgtccgcggtgtgcggcaccgcccagtcgtacgccgggtaggtgatgctggtcagcgccgcgcaccaccagaccagcacgaagctgaacgcgatcgtgctcggaatgaaccggaacgcgccgtgcaccagatcgagccaggactgcccgtcggccagcggggcgaacatccgccgcacccagccccgctcccgggacgaccggtaatgcgggtgcgggatcctgcggcccagcaccgatccgatccgcagccgctccaggtgggcgaagccgcgggacatggcgagcgacccggccatgatcggcagaccgatccagatgatcgcggtgccgaggccgaggaagaagccggtcaggcacagcacgagagtgatcaggccgagggggaaaccgagcagtacgtactgcgtgtcgatgcccagctggcgcaggtgacgccgggtgcttgtcatgtccttgacactatgcaccgcagccccccgatccgatcctgcggaccgcccgaccgacagtagggttaacccgaccgtcagggctgcgtcacgtcgatcaccaccttgccgaccgcatgattctcgacggcctcgtgcgccgccgccaccccgtccagcggaaaacggatgatcggcaggccgtgctcctcgccgacccggaagacgcccgcgttcgccgcctcggcgaccgccgccaccgcgttcgccttctcctccggcagggtggtgtaggtgagcacgaaatcgaggctggcattcttcaggttcgccgtgaagaacggcacccgcacctcaccggcgacatagatcgcgatgttcccgcccggcgcgatcacatccaggtcgagggtcaggttggcggtgtccacctcgacgatcaggtgcggaccggtcccgctcagctcgcgaatccgggcggccacgtcctcctcgcggtagtcgatcaccgcgtcggcaccggcggcggccgccagcgcacccttctccttgctgctcaccgtggtcagcacggtcgcgccggaccacttcgccagctggatcgcggcgttgcccaccgcgcccgccccgccggccaccagcaccgtgcgaccctccagagcgcccggtccgaggcgggccggtccgtcgctggccacggtcaggcagcgatgcgcggtcagcgccggaatgcccaggtccgcgccgacctcgaacggaatgtcatcgttcatccggaccacctggcggcggggcagcaccacgtactcctgggcggtgccgtcggcccggccgtagcccgcgtcccagacccagacgcgatcgccgggctccaggtcggtgacgccctcgccgagcgcgtcgacgacgccggcgccgtcctggttgggcacccggggcggtcgcacaccgtcgggcacaccgcggccggcccgggtaccgacgtcggtcgggttgaccgccgacagcacgatccggacccgcacctcatcggccccggccagcggcaactcccgctcgaccaggtgcagcacggcggaggcgggaccgggctcggcgaaaacggcagcacgcatgttctcaccctatgtcgccgcgaagccctcagccgatcgcgtgctccgccgaaacaacagcgaaagctccgatttttgtacgccgtcagcatgaccttttcgatcagcgcagtacgcctcagtggcctcagcgccgtgccgaacatgagtaggcacgtcgctgcccgacctctggaggtccgcgtgtacaccgttctcatcgccgacgacgagatcgaccatcgggacctgctggccctcgccctgcgccggttcggctaccacgtggtggccgcctcggacgcggccgaagccctggaggccctgacccggggcggcatcgacgccgccctgatcgacgtccggatgcccggcctgtccggcatcgacctgtgccgccggatccgctgcgatcccgcgctggacgcgttaccgatcatggtgatcagcgcggacgtgcaccaccgccaggtcaccgcggccctgcacgccggggcggacgactacctgacgaaacccttcgcccgggacgagctggtggcccggctgggcgacctgctgcgccggccgggcaccgggacgtcccgctcgacggccgcgtcccgggtcgcgctggccgccgcccggcacgcggtcccggtggcgccggtcatccgtcatcaggaggtccacgttcgacacagcgcttgacacccggctgacacccggctgacgcccgcggcggcgtagggtcggcgccatggaaccggccccgcacggcacctccgcccagctcagcagtcctgtccggtacgggacggccgccgcgcgccgggtgctgctggccaccgtgctcggctccagcctggcgttcatcgacgccaccgtggtcaacctggccctgcccgagctcggccgcggcctgcacgcctcggccgccggtctgcagtggacggtgaacggctacgccctctccctggcctcgctgatcctggtcggtggctcgctcggggaccgcttcggccgcaagcgggtcttcctggccggtgtcgcgtggttcgcgctcgcctcgctgctctgcggcctcgccccgagcatcgagctgctgatcaccgcccgggtcctgcagggcatcggcggcgccctgctcaccccgggcgcgctggccatcctggaggcgtcgttcgcgcccgatgaccgcgcccgggcgatcggcgcctggtccgggctgggcggcatcggcggcgcgctcggcccgttcctcggcggctggctgctccagatcggcagctggcgcctcctgttcctgatcaacgtgccggtcgccgcgctggtcctctgggtcgcgcaccgccacgtgccggagtcccgggatccggccgcggcccgtggcttcgacatcgccggcctgctcaccggtatcgtcggcctgggtggcctgacctacggcttcaccgcctggccggcgcacggcgcgggctccccggtcgtgctgatcccgctggcgctcggcgtgctcgggatggccgcgttcgtcctggccgagcttcgcgcaccgcacccgatggtccccccggagatcttccggcaccgcgccttcaccggcgccaacctggtcaccttcctggtctacgcggcgaacggcggcgtcttcttcctggtcgtggtcaacctgcaggtcgtcgccggctatcccgcactcgccgccggcctgtccatgctcccgatcaccgtgatcatgctcctgctctcggcgcgcggtggcgcactgggccaacggatcggcccgcgcatcccgatgaccgccggccccctggtctgcgccgccgccctgctgttgatgtccaccatcggcccgcacgcgccctacgccacccgcgtcctgcccgcggtcatcctgttcggcctcggcctggccctgctggtcgccccgctcaccgccaccgctctcggcgccctcgacgacgcccacgccggcatcgcctccggcgtcaacaacgccgtcgcccgcgccgccggtctcctcgccgtcgccgtcctacccctggccgccggcctgggctccggctccctgaccgacgccgccgcactccaccccgtgtaccaccacgccatgctgctctgcgccgccctgatgctggccggctccctgaccgccttcctcaccgtccccacccggccacccaccacgtcctccacccccagcccgcactcccccgacagcgccgactccaccccgaccccggccatcaccgccggccgcacccccgccatcccgcaccgctccttctgcgaccccgcctctccccccatccctccccgcgacagccaccccatcccctcatcaccccgctgacctctcccggccagccgcacacccgcgatcgcgcccatggcccgggcacccatcaccttccggccgaaccccagccagccgccgtcccacccgccaacacccgccgcgctccaggccggacacgaggggcggtgcgctgggactgaacgccttctcgaccaccttcggcgaccggttcccggcctgctccggcgacggctgccgcccgtcgtcagcgttcttctccagcggactcacaacgcccgatgtcactactcacagtgcccatcccgccagacctaagcccggcgcgccgggccggaaacaccgctcccggcgcagtccctacggacccggcgggacggcccgggtcagtagtgggcggtgatggtccgggcggggccgttgacggtgaggcggccgccgtaggggaggacccactgggggctggtgtgtccgaagtccacgccgaaggtgagcatcgctgtggggtgataggtcgcgaaggctcgcaggacggcctcgcgctggtcgtctcggtacttctggcgctccgggtgggggcgggggctggtgaagactgtcgccttcgcggtggcgaacagggcggcggggaactggtgcagaaggcctcgttcgccgaagttgcggaggattcggaagacctcctcggcggggggcatctcctccgaggtctccagcagcaggatgtgaccggcgtagtcggcgaccgggcggatccagcggtcggcggccaggttccagtggaggatctccaggttgccgccccaggtcggggcggtgagcacccgggtcggctggtgccagatccagccggggccgggggcggtgggcagggggtccgtcagcgaccggggatccgaccagtcgatctcctcctcgctgaaggtgtcgatcggtgtgatcggcaggtcgccgccggtgaacagggcggctcgcagggatgccaggtggatcggcgggatgccgtcgccctgggccaggtgcatcatcgtggaaccgccgtggtaggccgggatgccgtgcgaccacagccagttcagcaggttggtgttgtcggagaagccgaagaacggtttcgggtcggcctggaacaccgccggatccaggtgtggcagcacggtgatctggtcgtcgcccccgatcgtggcgaacacggcccggatcgacgggtccgcgaaggcggcggtcaggtccgcggcgcggtcggcggctgaggcgccgaggcgacgggtggtggggaactcgaccggctccagaccgaggtcgtcgcggatgcggcggatcgcctgctcgtggcgttccgggaagaggcctggcgaggcgaatgacggcgacaacaccgccacccgatcgccggcgcgaagcttcggcagctcccgcgccaccgacgatcccaccgccaccgcgggcgccgacccgccggccgaaggcgcaagtccgggcccgggcaccggagcgggcccggaagatggcgccgacgcgggctcggcggggtgggagaacggatcatcggtggcggacgggggcataccggtcgatggcatgcccccgattctgactaggtgaccggcgccgtgcccagcacttttccgtcgctgtcggtgatgacgatcgcccggacgtcggtggcggtcaccgagctggcgccatcgaccttggcggtgtgttcgggggtttcaccccaggcggcggcctgttccatggtgccgtcggctcgtttgaccatgcagaagaacggggctttgccctgcattccggtcatgttcagcgataccgaaacgccccaggccttcttgaccagggtggcctggccgtgcagggcgccgccggcggtcggttcgaagttcgccgttatcgtggcggccgcgagcggcggggactgctgggtggtggcgtcgttgtcgtggaccagcacgccgtagccgatggcgccggcggccaggacggcgaccgaggcggcgaccagccaccgcgtacgcaccatccgggtcttgtgggttctctcggcccgcatccggctgagcagattctcgatgttctgcggactcggccgcgcggccggagcgaccgtgagcggcgggagatcaccgcccagctgccggacgtccggcaggtgttgcagcatttccgggaccggtgcgagccggtccagttcggcccggcattcggcgcagtcgtgcaggtgcgcgtcgagccggtcggtgtcggcctcgtcgagaccgcccagcagatagccaccgagcagacgatgcaggctgtcgtgctcgtcaaggtcactcatgccgcacccccgtcccggcgccggaatcgcggcggagacggccggtccacgggtttcatgccgcacccccgctccgcagcatgcccatctcctcgaagacggcgcggagtgcgcgcaccgcgtagtaggcgcgcgatttcaccgtgccttccggcaccgacagccggcgtgccgcgtcggccacgctctgtccctcgtaatacatggcctgtatcaccgcccggtgttccggggagagccgttccatcgcttccgcgaccagccagccctccaccatttgatccacattgtccgccgacggcacggagttgaccgcggtctcgtcggagaccaaccggggccggcgttgttccgcccgccatgcgttggtcaccacgttacgggcgatggtcagcaggtatgacctggttcgtcccggttcggggtcgaggtggtcgatgtgcttccacgcccgcagcaacgtctcctggaccaggtcctcggctttgtgccggtccgagacgtatcgcgagacgaagttgatcagaattgcgtagtgctccgtgtagagcgcggtcatcagttgctcgtcggggctgctcacccgtcgcttcatcggcgccagctcccctcgggttccgcccggccacccggatgtacatcgtggcacgcggacaggttcaccgtgagcccgaaaaacatcggcgcccgatccctcgacggggaccgggcgccgaaagcggatagatgaagatcaacagctgccggggccgccgtagcggaaggtgcggttgctcaactggttgaccgtgtaaaagtcgctggtgctgcggaccaccaggtcggcggtcggcccgttgacgtaggcgatgctgccgatccgggccgacgtggtgtcgtcggacttcttgccgttgcccatctcggtgcacggcttgtcggacgcggcggccacctcgccgaagacctggaccagaccgctcttggtgaacgagacgtcgccccagagcttggccgggaaatagccgacccactcggtgtcgtacgccacccaccagccgccgttgtagaactggatgccgaatttcttctgctggtcgacggcgagcgtgtcgccgggcaccacggccttgctgtactgcacgaagccgcagccgttgtagcaggacgtctgccggttgacccagtggtagacgaacaggtgcgggtcgtcgtcgccgttgaccacccggtcgacgttccacccgatctcgacgatctggttgccgtccgcggactgcacggccagctcggccagggtgtggtaatcctgcttggccagtttcggcttgttgatcgtcaggttgatgtaggcgccgtccgagaccgcggcctgtgcgccgacgttgtagaggaagttcaccgtcgggccggtgctcccgggggtcgtcgacgggtcggccgaggccggtgcggaggcggacgcggacgccgaggcggacgccggtgcggacggatcggcggacggttcgggaggcggcaccaccgacgtcttggcggtgcgcaggaagctggacctggagctgcggcccttgggcgcgtactccggatcgggggtgccgttgtcaccctcggacgggccggcgacgctgagcccggcggcctgcagcgatcggctgttcgccccgtcgcggccgcgcttgacccgggtcgggcgctgcccccacggcaggttggccggcgggatgaggtcggcgggcgcggcggcgacactcgccgtgggcgccgcgtccgggatctgctcggcccccgcgttgagtgtggaggcgactccgatcgcgccgatcaccgcgacgctgaggccggcggcgagcagaccgcggcgtgacttcaacacgtgtccgtcctcgttcatcggggggtcgcgccggctcccggcggcgcagctcaccatatagctttctcaattgcccagggacgtcctgaccaggaactctgccgtaacggctgaagcggtcggccgatccggtgacagcacgaccactttgttcaaccgagcgtgtccacgccattgcggatcgcagtttcacgcacatggtcaagaaagaggcaaattcggtggagcctctttcggggtcacgccggatccgggaaccggccccatcgccccgagttctgtggtaaaacataccttgccgataggtaataaaggaaccgcgaggagattccgcatgcccgccaccgccgtccgcctcgaccacctcgccatcgcccggcaattcgccaacgcgcccgaggggtgggtggtgccgccccgcttcgacccggtcgagcggtggtaccaccggctggaggtggccgacgaccacgaggtgtggctgctcacctggctgcccggacagcagaccgaactgcacgaccacggcggctcggccggagcgttccaggtgttcagcggcgtgctcaccgaggacacggtcagcggcccggcggacgcgccccgggtcaccacccgcgacctcggcgagggcgccggccgccggttcggcagccaccacgtgcaccggatcgtgaaccgcgggcccgacccggcgatcagcatccacgtgtacggccccgccctgaccagcatgacgaagtaccggctgagcccggccggcctggagacccgcaccgtcgaacgggccggtgcccagtggtgaccgcggccccgcccggctcccgcggcatcgccgagatcctcgacgaggcccgcacccggctgacccggctggacccgctggagaccgccgccgcggtccgggacggcgcggtgctgatcgacatccggccggccgcgcagcgcgccgagcacggtgagatccccggtgccctgatcatcgagcgcaacgtgctggagtggcggctcgacccgcgcagcgacgcccgcctgccgttcgccgacagctacgaccttccggtgatcatcacctgccaggagggttacaccagcagcctggccgcggccgccttgcaggatctcggcctgcatcgcgccaccgacctggccggcggtttccgggcctggcaggaggccggcctgccgacgatctgaccggagggctcgtcaccccttcccgaccgatcgcgtcagtccgtcgatcagcaggtcgaggccgaactcgaagcgctcctgcgaggtgcccgaggtcatcgccgccgcgtgcgtccgcagatacgggaagcggtcggccggcaggtcctcgaagtgcttcgccatctcgcccttgacctgcttctccacctcgtcctgcggcagctccaggtgacgcagctgggtgacccagatggagatctcgtaagcgtccgtggtgacgtagaggaagatccggtcgagtgcccaggccgcggtccgcggcgacaccccgccctcgatcagcagcccgatcatccactccgagcagcgcagcgcgttgggcccgttggggatcgaggccagcgcgacccgcgccaggtcgttgtgccccagcaggacctcgtgtacctggcacatcatctgccggatctgctccgcccagcgggccggatccggcgtgggcaggtcgatctcgccgcacacccggtcgaacatcagccgcaacagctcgtccttgttggacacgtgcgcgtagaggctggacgggccggtgccgaactcggcggcgacccggcgggtgctcaccgcctcgacgccctcggcatccacgatccgcagggcggcgtcgatgatctgctcgcggtcgagttgcacgcgagccgggcgcttgtcgggaagcggactccagggcgaggtcttcatcggcacctaatttacttgacaccgagcaccgttcacaactagaacggtgtccgtgacaacgaacagtgttcaaacagaaatccaggcgaccgacacgccgtatcgatatcgttggatcgtcctcttcgtgatcctcgcggtcgaggtgatggacctgctggactcgctggtcaccacgatcgccggcccggtcatccgatccgagctcggcgggtcgtacagcctgatccagtggctcggcgccgcgtacaccctgtccatggccatcggcctgctcaccggcggccggctcggcgacatctacggccgccgccggatgttcctgatcggcgcggccggcttcaccctcgcctcgctcgcctgcgcgctcgccccgatgcccggcttcctgctcggcgcccgcgcggtgcagggcctgttcggcgcgctgatgttgccgcagggcctgggcatgctgcgcgagatgttcgccccggccgagcgcgccaaggcgttcggcgcgttcggcccggtgatgggcctgtcctcggtcggcggtccgatcctggccggctggctggtcgacgccgactacttcgactccggctggcggatgatcttcttcatcaacctgccgctcggcatcttcgccgttttcggcgcgctgcggttcctgcccgagtcgcggctcgaccgggcgccgcggctcgactggctcggcgtgctgttcgccgccggtggcgcgttcctgctgctctaccccctggtgcagggccgcgagctgggctggccggcgtggaccttcgcgatgctggcggtcggcgtgctggccttcggcctgttcgcggtctacgaggcgcggcgcgacaagcgcggcctcgacccgctggtcaccccgagcctgttccgcaagcgcgccttcaccggcggtctggccctgggcctgatgttcttcgcctcgctgatcggcaccagcctggtcttcaccttctacctgcagatcgggctgggctacaccccgctcaaggccggcctgaccacgctgccgcaggcactgggcatggtggccggtttcatcgtggccggcgccgggctggccgagaagctcggccgcaaactgctgcagctcggcaccatcgtgatggtgatcggcacgggggtcttcgccgccaccatccactgggccggctccggcatcacgccgtggcacctgatcccggccctgctgctgctcggcatcggcatgggcctggcgatggcgccgttcttcggcatcgtgctggccggcgtcgacgacgaggagagcggctcggcctccggggcgatcacctcggtgcagcagctcggtggggcgttcggcatcgcggtgctcggcacgatcttcttcgccctgttgcccggcgcggtcgggcaccacgtggacacctcggcggaccggctgcgggccacgctgagcaccgccggcgtgccggccgacgctcagccggcggtgatcgccgggctgcggacctgcctcaccgaccgggtggccgagaccaatccggacgtggtgccgccctcctgccactcggacgcggccgggccggatctgtcgcagtacgtcggcgagcaggtgcgcgccggcttcgaggacaccaccgtacgtacctccgccgtgaccttgatcttgttgttggcggctttcgggctcaccttcctgatgccgttgcagggcaggccggagggcgagggccactagatcaccgggggtagacgacacccgagcgcccgctgtacaggtgccgggtgccgtcccgctcgtagccggtgttgggcgcgtccagccagacgatgtaggccgcgcccgggaccagcccggtgatcgtcgtgctgaccgtgcaaccggtgccgggcggcacgttcttccaggagggctccggctgcgcaccgaggaccagtttctgcggtacggcggtgacccggtagttggagccgtactgccggggccactccaccttgaagcctccggcgatcggcgtcacgtccaccgggatcagcaccgcctcggtcgcggtgaacgtcttcgtgcagctggggaacggtgacaccgacgcgcccagcccgggcgccgacggccgcgcggtcagccgcgacggcgtgggactcggtgtcgggctgcccgtggtcagcagatgccaggtcgcgcccgggctcggcgacgccgcggtccgcaccgtctcgcggccgcacccaccggccgtgagagcgagcgccgccagggcgagcatggccttgacgtgccgcatcccgacctcccctccccctacccttcggcggcctgcccggccgggcttagcggcggtgcgaaccgccagccggcggccagcagccggtccaccgcccggatcgcggtcgtcagccgctcccggtagccgccggtcagctcgatccacggcacgtcccgcgcggccagctcggcgcggaaccgcccggtcatccaccgccgcagatgctccccgtcgcgcagcccgtcatcctcgaacggcaccccggcgtcatcggtgagcagatagaggtcgggatcgcggaccagctcgccgaccttcgccgaggtgctgccgagatagcgctcctcccagatcgtggtggcgaacgcgtcggtgtcgccgaacaccaccggcgagcccgcggcggccaccgcgtcctcggcggcggcctgctccacggccacggtgatgaagtcgtcgcggtcccaggtgacgtcgaagacggtcgcctcgggccggacccggcgcagggcggcgagcttgcgcccggtcagttcccggccgaactccggcacccagccggtcgacgcccagaccccgccccgggtccggtagtgccgggccagggcccgggccgtcgtggtggtcccggtcgactcggcgccgaccacgatcacccggcgggccagccaggcccgcggacccggcccgaggtgcgcccagtgcgcgatcgggtcggcgcggatcgcgctgccggagatcggcacccggcggcggtccgggtcgaccggcacggcgacggcaccgaaccggcgggccagctccgctccgtacgcctcggaggagaacaccgcgtccaccggctcggcgccgaccgcgtcccggaagaccaccatgtgcaggtcccagacggccgggtcggcatagtcgatcgggtgatcgtcgtagaccccggcgaaccggacgtccggcccgtgcgccgcgcgcagccactccaggcgcaccgccagcgggatgctctcccgcgacgacggcgcgaccaccacggtcacccggtcgcaggccgcggcggccgcctcgatcagggcgtggtgcccggcgtgcggcggatagaacttgccgacgatcagtccgtgccggaacctcacgcggtcaccgcccgccgccaggaccgcagcccggccacacagagggcgaggaacgccacatagaggatcgcggtcagccagagctccttgtagcagtagagcgggatgtagatcagatccgccgcgatccacagccaccagctctccaccagcttgcgggtctgcccatacgtcgccagcagtgacaacgcggtggtcaccgcatccgccagcggcaccgtggacccggtcagccggtccaggaagagccacaacccaccggtcagcagcaccccggcgacggccagcgccagccactccgcccgggtggtgggccgcaccaccagtgcggtgtggtccgcaccgccgcgaagccacgcccaccagccgtacaggccgaggatcacgtacaccacctgcaggcccatgtcggcgtacaacccggccgtgccgaagaccagcatcagcagcagcacgttgaggatgccgagcggccagttcaggacgtgctgccggaccagcagccagacgttcagcaggccggtgaggaaaccgagcacctcggcccaggtggtgccgacgccgaaggcggtcagcgcgacactgttcaacccatcgatcaccgcgacagcatggcggaccggatcactccgggagaaggcggtggccggccatctccagttcgccctcgtgccggacgtggaccgcggtgttcagaccggacgtgtcgtcgtgcaggacgagcgcggcgccctcgacgcggtaggtgccgctcggacggttgcggcggccggcgacctcaccgtggtacgtcccgtcggtccgcagctgcagtttgaccgtgccgtccgggctgcgccaggcgccggcgaccgcggcgccggtgaccacccggggcgggtgggaccggacgccgagaccggtctcggaggcgcggcccatggcgatcgcgagcagcgccgcggcgtccagcacggtggtgtcgactcggggggcggggtgcatggcccccacagtcggcgggaacaccgccggctttaggttgccgaaccaccgcgcagggaaccgaggaccgcggccgccagcttctccaggtaggcgtcgtcgatcggctgccgggagacggcgagccgccagtacagcgggccgaggatgaggtcgacggcgacgtcggcgtcggtgccctcgggcagttcgccgcgcgcgacggcctggccgaccagcttgtccccgaccgactgctggtgcagccggagcacccgttgcagggtttcggcgatctgcgggttccgcgccgcctcggccatcaggtcggggatgatctgcgaagcgacccgatgctgcaacgcccggctgacgatcatcatcagcaggtcgagatcgctggcgaagctgccggtgtcgggcaccggcaccttccgaccggcgacatcggtgatgatctcaagtaccatctccagcttgttggaccagcgccggtagatcgccgtcttacccacgccggcccgccgggccaccgcctcaatggagagccggccgtaaccgacctcggccagctcactcatgaccgcgtttcggatcgccacggtgatgtcattccggagcaccgccgctccggccggtgcgcgcttcactgtcgccacgcggtaactatagcgctacgacgtaacggttgcgttccgccgttcggtgagttaccgttcctcccacgtcgatacgaacccgttctatcgacgtcggcgggcgcctgtcatgctgctacctgtgtctgaaggcaagtcaccggagtccgccgcctcgtaccggccgacgagatcggagcaccactccatgccagagacagcggttgccgatgccgctaccgggattcccctcaaggaactcgcccggcggcacggcctgagctcgtccgggcgcctgctcggaccgctggagtacgcccgccaggtgtggggttatcggtacttcatcaccgcgcacgccaaggcgaagacggtgtccacgctgggcaccacgaacctcggcacgttgtggcaggtgctcacccccgccatcaacgccctggtgtactacgtcatcttcggtgtcatcatcggcaccggcgcgaacaatccgaacttcatcccgtacctgtgcatcggggtgttcgtcttcggtttcacccagtcgacggtgtcgcagggcgtcaactcgatcaccggcaacctgggcctgatccgggcgctgcacttcccgcgggccagcctgccgctgtccgccgcgctcgtggagatccggaacttcatcaccgccaccggcgtgctgttgatcatcgtgctgctctgccacgagccgatcaccgtccagtggctgctgatcttcccggtcatgctgctgcagtcgctgttcaacttcggcctggccatgggcggcgcccggctcggctccacgttccgcgacatcaagcagctggtcccgttcatcatgcggttctggatgtacggctcggccgtgctctacccggtcacccgcttcacccatgcccatgccctgcaggggtggaagctgcacctgatcgaggcgaacccgatgctggtcttcgtcgagctgtaccggcactcgctgatggagggccaggagctcgtcggcacccccaagatgctgtggatcgagggcgtgatctgggccgtggtcgtgggcaccgccggcttcctgtacttctggcgtggagagaagggttacggccgtggctgacgagcggatccccaccgtcatcgccgatgacgcccacatcgtctacaagatcgtcggggcgatcggcgccaaccaggtcagcccggtctccgcgctcaagcgcctggtcaccaagaccaactcggcgaacgtgcgcgaggtgcacgcggtcaagggcgtcagcttcgtcgcctacaagggtgaagcggtcggcctgatcggcagcaacggctcgggcaagtcgaccctgctgcgtgccgtcgccggtctgctgccggtgcaccggggcgcgatctacgcggccggccaaccgtcgctgctgggcgtcaacgcggccctgatgaacgacctgtccggcgagcgcaacgtcgagctgggctgcctggccatgggcatgaccccggccgaggtcaaggagcgcaagaaggagatcatcgacttctccgggatcaacgagcgcggcgacttcgcctcgctgccgatgcggacgtactcgtccggcatgggcgcccggctgcgcttctcgatcgccgccgccaagcagcacgacgtgctgctcatcgacgaggcgctggccaccggtgacgccaagttccgccgccgcagcgaggcccgggtccgcgagctgcgcgcccaggccggcacggtgttcctggtcagccacagcgagcagtcgatccgggacacctgcgagcgggtcatctggctggagtcggggctgatccgggcggacggcccgaccgaggacgtactcaaggagtacgagacctacatgaagaagtaggttcgctcgtccccagcaagaagcccgggccatcggcccgggcttcttgcggtttctagatgaccgacaggtgtacgtggttggtgtggtccgtcgagggcgtccccccgaccccgctgtacgccttccatccgctgctcggcaaccagatccgtttgaaccagatcacgtagaggacgccgagggtgtccgagttgtggatgaagtagttcgccaggtcggtgccgtaggtcttgctgctcccggtcgccaccccgccgaagccgcccttgtcggcggcgaagtcgcaggcccgccccttcggatgctccccactgttctgatgccggaagcacgcgacgtagtgggtgaagccggccttctgcgcctgcttcatcgcgaacagcaggcgcggcgtgatgcagccggtggtggtcgggtcgtcgaccgtgcagccgccggccaggctgccgccgggcttgtccgcgttcgagctgctgccgccgccggagttgtcaccaccggagtcgccgccctggttggcgttcttcagcgcctgctcggcctgggtcttgcgggcggccatcaccttggtcagtttcgcctggtcggtgaccgcctggtcgatcgcggccttggcctgctgccgaccggcccgggtggccttcagctcgtcgagcgccagggtctgcttggcggccacggtgccgagcatctgggcccggtccaggaacccggccgaggtgttcgcggtgagcagcgcgctcagcgggcccaaccggcccatcgtgtacgcctgcgcggcgtacctgttcagcgcggcctgccgcgggcccatgtcggcgtcgagctgcttgagctcggcggccagtttcgtctgctcggcccgggactgcttgagcttggcactggccgtgacgtaacccttggaggcctcgtcgagtttgtcgagcagggacttggagccgccctcaccgtcgtcaccggactcccccggggcggccaggggccggggagcggcggcggccggcgtggtcacgccggcgatcccgcatgcggcgaccagcagcgcgagaacggctgcccatcgtcgccgtgccgtcacatcctgcacagggtccatttccttccgtcggccgccggccgggttagctgacgggttcgggacgaaggaaacccctaccgctggcgcggattcaccccggaagaatgtggatccccggctcgctcagaattctcaggatctgcgattaggcggcggtccccgggtgggaaccgcatcagaccatacccactcgatcgaggaatcgacagttctcgcaccgattgctacgaggcggtcaccaatggtggtggcgattacggaaagtcgttgggcggtaacagctttgccatttcccggaccctgatgtccggagatatctcaggtaaactggccgccggtcctgccaggacggcaccgcccccgagttgccggcaggccgccgcccaatcaccgaaaggtgagccggggaaccaggtagttggggtgaatccgcgataagcggtagggatagcttccgtcccgaacccgtcagctaactcggtcggcggtgactaggaaggatagttgatgaccgcacgtccccgccggtggctgatgcttgccctggcgccgctcgtggccaccacgatattcgtggcgcccgtcacgccggcacacgccgcgccgagcggcagttcgtcgacgacaccctcggagggtgacgacggcgacgacctctccgatcagatcgaggcgaccaaccggcggtacgtgaacgccaagctcgcggtcgaggcctcgcagaagaagcagaaggacctcgccacccagatctccgccgcggagaagcgccgcgacgcgctgatcccggaggtcaacgcgatcgcccggcagcagtaccagatcggccagctcaccacggtcggcttcctgctgcgggccgactcgtcgagcgacttcctgcacaaggccatcggtcttgaggagatcaacaagctcaacgacgacaagctgaaggatctgaacaccacgctcgccacgatcaccaacagcaagtcggcgctcgacgccgagctgaagaacgagcagcagcagctctccatccagcagaagcagcacgacactgcggagagccagctcgacctgctcggtggtggcaccggcatcaacaagaccatcaccgccggtttcgtcgacgcgacgtccaaggtcgcggcccccgcgccgcgcaactccagcggcggattctcgcccgagtcctgcaccgtggacgacccgaccaccagcggttgcatcaccaagcgcaccctgcacctctaccaggaggtgaagaaagccggcttcaaccgcttcgtcgggtgccaccgcgacggcggcccgttcgagcatccgaagggtcgggcctgcgactggtccctgcagaagagcggcttctcggtcgcgcacaacagcgacatgatgcggtacggcaacgacctcaccgcgttcctggtacgcaacgccgaccggctcgggatctactacgtgatctggtacaagcagatctggttcccggcgaccaacaactggcacgcgtaccacggcccgagcgaccacacggaccacgtccacgtatcgctgctctgaccggtcgcaaaaagggcctcccgccgtgcgggaggccctttttccgctctacgtcagttcggcgtggcgcgccgcaccggcgcgcggccggctagctagctagccgggcgccgggatcgccatggtcaccgggcggacctgggtcacctcgatctccttgccgtggtgcagcagagtgagccgggccgagccgccgccgttgcgcagcgagtaggtgacctcgctcgcggtcacgttgacccgcagccgcagaccccgccagagcagcgagaactccaggttgttgatccggctgggcagtcgcggcgcgaacgacagctgcccgttgaaatcgcgcatcccgccgagcccggcgaccagcgcgatccaggaaccggccagcgacgccacgtgcacgccgtcccgcgcgttctggtgcaggtcgtgcaggtccatcagggcggcctcgcccagatagtcgtgcgccagctccagatgcccggtctcggccgccatcaccgcctggatgcaggcggacagcgaggagtcccgcacggtgcgggcgtcgtagtacgcgaagttgcgcgccttctcctccggcgtgaaggcgtcaccccggatgtacatcgccatcaccaggtcggcctgcttcaccacctgcttgcggtacaggtcgaaatacgggtagttgagcagcagcgggtagccctccggcggagtgttctcgaagtcccactcctgcagccgggtgaagccctcgcactgctgatgcacacccagttcgcggtcgtacgggatgtgcaccgccgccgcggcatcccgccacgaggcagcctcctcgtcgtccaccccgaaccggcgcgccaggtccgggtgccgcttgcaggcgtccaccgcggccatcaggttctgctgggccatcaggttggtgtagatgttgtcgttcaccaccgcggtgtactcgtccggaccggtgacgccgtcgatgtggaaccgcccgtgccggtcgtggtgccccaacgaccgccacagccgggccgtctcgaccagcagctccaggccgacctcccgctcgaagtcgtagtcgccggtggcctgcacgtaccgccggaccgcgtcggcgatgtccgcgccgatgtggaagcccgcggtgccggccggccagtaccccgagcactcctgcccgcggatggtccgccatgggaaggccgcgccctgcagccccagcgtctgcgcccgctcccgggccaggtccagcgtcgaatgccgccagcgcagcacgtctgccgcggcggacggctgggtgtaggtcagcgcgggcagcacgaacgtctcggcgtcccagaacgtgtggccgtcgtagccggggccggtcaggcccttcgacccgatcgggcgctgctccgcccgggcgccggcctgcagcgtgtggaacaggccgaaccggaccgcctgctgcacctccgggtcgccctcgacccgtacgtccgaatggtcccagaagccgtcgaggaactcgcgctgctgctggaccagcccctcccagccgtccaggcgggcgctggccagggcggcgccgacctgatcgcgcagggcgggcagcgagcgcatcgaggaccagccgtacgcggcgagcttgaccacccgcagcttctgccccggctccagacggcaggcgaccgtggtgcgcagccagtcgtcgtgtccctcggtggtgatcgcgtgccggcccggcgtctccaccaggtgctccatggcggccgccatgcgcaggtcgctgaccttggtgtggtgcaccagcaggccaccggagcgctgctccagcatctcctcggcctgcaacggctgctccagcaccgcggccacccgcgggtccttgctctgcggcggcagctgctcgttggccaccagctcggactgcaggatcagccgggcggcgccgtccaacggctcgacctcgtagaggaaggcgacgaccgcgcgctgggtgaacgagaccagccgcacggtgcgcacccgcacgccctggccggacggggagacccactccaccacccgctccagggtgccggcgcgcatgtccaggacacgctcgtgggaccgcagctcgccgtagcgcacgtcgaacggctcgtcgtcgaccagcagccgcatcagcttggcgttggtgacgttgaccatggtctggccggactcggggaagccgtaccccgcctcggcgtgcggcatcggccgcagctcgaagaacgaattcagatacgtcccgggcaggccgtgcggctcaccctcatccagattcccgcgtatcccgatatggccgttcgagagagcgaaaaccgactcggactgggccagcaggtccaggtccagccgggtctcccggatgtgccaggggtcgacggggtaggcccgttcacggatcacggtcgtgcctcttctttatcgatcttggttatcgatcttcgtttaattactggtcgagcaggtcggccaggtcatcgaccacgacgtcggcgccgttctcccgcagcgcttcggcctggcccacccggtcgacgccgatcaccagaccgaaccggccggcccggcccgcggcgacaccggcctgggcgtcctcgaagaccgcgcaggcggccggatcgaggccgagcagtttcgcgccgtgcaggaacgtgtccggcgcgggcttgcccggcaggcccagttcccgggcgacgacgccgtccacccgggcctccaggaggtcggcgataccggccgcctccaggacgtccttgcagttggcgctggccgagacgacggcacggcgcaggccggctgccttggccgccttcaggtactccaccgatccggggtagacctgaacggcgccctccttgatcttctgcagcaccaggatgttcttccggttgccgacgccgttgacggtctcctggtcgggatcgtcgtccggggtgccctcgggcagggtgatgccacgggaggcgaggaaggtgcggacgccgtcagcgcgctgacggccgtcgacatatcggtgatagtcggcgcctgaatcgaacggcacaaactcttgatcatgctgccgggcccacgattcgaggaacgtgtcgaacgtttgtttccacgcggcactgtgcacaagggcggtctgcgtgagcaccccgtcaagatcgaaaaggcaggcggtcacctgggaaggaagtccgagcacgcgcccaatgtagtcgcacccgccgcacaacgagaggcgaagggcgccttcacatttccgcggtgtttcataagccggtcaagctgctgtttcagctttcagctcgccgtaacaagatccattcggaggccgatcgaggtgccgatcgggcccgtggccgtcgtcacctcgtcacacaactggtgcgccagccacagcccacgaccaccgatctcatccgtaccggggagaagatcgccgtccagacagccctccgggatgcccggccccgaatcggtgaccacacaccagaccgaccccgcctccagccgcagcacgatccggccgtgcccgccggcgtgcagcaccacattcgtgatcacctcgttgatggcgagcacgtaaccggagaggcggtcaccggagaccccgaccgcgggcagcagccgggtcacctcgtgccgcagaagggtgatgtcggcgtggccgaacgcccggtccagcagcaccggggaaacgggccgtggccgggcggcatcgaccctcggctccccacccggagccgaacgcacggtctggccgatcctgtcctccaccgtgctgcagcctacgcgctgtggccgttcggtggcaggaggcatccgcgatcccgcccggaagtggcgctccccctcggtacccggcacctcatccccccgggtcagcgccagcccacgtcgatgcggtcgccgcgctcgtcaaagaagtgcacggcgtccatctgcaccgccacggtcaatgggtggcccggagtgaccgccggatacggcgccagccgcaccgacagctcggccggcttacggtgatgccggcccggatcgttcagcacactgaccggcgcgaccgggctctccgacgcctcctccggcgccgaccgggtgagccgctgcagggctccgccgagccgcttcaacgcgccacccccggtcgccgggccgcgcaccggcccgccgacctcgtcgaccacgatcgcggtcgccccgacatccaggtaggccagcgattcgtgcccgtggtgctccagataccggatccggccgtgcaacaccgtgccgggtgtgtcgggggtcaccggggtgagcgcctcggcccgcacccccaccacgatccgctcaccgtggtagcgggccaccgcccgcgaccgcggatccgtccagccgagatagagcgtctgctccccgaagttcaacgcgacgaaccggtccaggtgcacgtagacctgggcctccagcaggttcatccgcggcgaccccaggaaagccgcgacgtagagcgtcgccggccgccggtacacctcggtcggcgtgcccaggtcctgcagcaccccgcgccgcatgatcgccacccggtccgccatggtgagcgcctcggcctgatcatgcgtcacgtacatggtggtgaccccgagctcccgggtcatgctggtgatctcggcccgcagttcggcgcgcagaccgctgtccaggttggagagtggctcgtccatcaggaagatgcccggccgccgcaccatggcccggcccatcgccacccgctgccgctgcccgccggacaactgactcggccgccgccccagcacctcgccgatcccgagcgcgccggccaccgtgcccacccggtcggaccgcgaccccggctcgacgccggaaagcttcaacgggaatccgatgttgtcggccaccgtcatgtgcggatagagcgcgaaatcctgaaacaccatggcgatgctgcggtcgcgcggaggcacgtcgaggaccggctccccgttcagcaggatgtcgccctcggtgggatcctccaggccggcgatcatgcggagcacggtcgacttgccgcagcccgaaggccccagcagcaccatgaactcgccgtcgcgcacatcgagggacacccgatccacagcgagcgtgccatccggccaaaccttgctgacatccttgagcgcgacggtggacaccgccaacctccccgatcgactgtgatcccgatcccacgacggtcggcgatcggttaatgactttgcgagtggcgtcgatgctttgccatcgggcgaacgtgccattcgcggatagtgatcaatcgattacggagatccgaactctcggccccattctgtgcacgttcccagcaagaaccgacatttctcccggtcagcaaagcgaccagccccgcccgctaaaaccgcggcgcgtaccccggacgaacaccgcgagcagacgaccgccgacgccgacacctggagcggcggacggcggaggcggcgccgcgaggaccgcgccgaggaaggaccgcgccgaggaaggaccccgtggagcgagaaccccgtggagcgagaaccccgtggagcgagaaccccgtggagcgagaaccccgtggagcgaggaccgcgtggagcaagggcggcatggcgcgtggaccgcgtggaccgcgggaagcggcggcggcatggagcgaggccggcatggagcgggaaaagttaacgaagggcgacattcgggtacgggtttcccctacgggaagcgggccggaactctccatcttcgggatgagggacggccgtggcccggtacctaacgtcgaagtggtccagggcaaaaccgccccggccaccactgaaggagtggatgacagtgacccgccccctcgcgtcacacagcctgacccgcccgcgcgacaaccgcatgatcggcggcgtctgcgccggcctggcccgccgcttcggcctctccaccggcgtcgtccgcctggccttcgtcctgtcctgcctgcttccgggcccgcagttcatcgcctacctggtcctctgggccttgatgcccagcgagtgaccacccactgaagccaccgcccagcgcacctgccgaccgatagctgaccgccgctgacagcgagcacaccgtcgccggcagcgagcacaccgtcgccggcagcgagcacaccgtcgccggcagatcggcggggcgccgtggaaaggctcccggccgggtggaagccgggctggcatacccggccgggaccgaatcgcaccaacgcggcattcgccgctcacctacagaatcgcgggcccggtctccaccttcccccgattcggacgccgtcgcccttgcccccagggcggcggcgtcactcttcgcgctggtcgtcctcgacccgtgccccgaggagaacaaccggcgaagcccatcgccacggcggcacgatccccagcccgccggcgagaagacagccgctgacagacggaagaccgcgaccacgcagccacaggccgcagatggaagaccgcgaccacgcagccaccggccgcagatggaagaccgcgagcgggaggccgcgacgcaccgggcaagagaccgcaggcggaagaccgcagcgcggccaggcggaagaccgcagcgcggccaggcggaagaccgcagcccacgcggacagacgaccacagcccgcccagaacacgggcgaggcacccggctgaagggggccgccgggcggacgacgcgaggccgcccgcccgccggtcaagcccgtcaggggttggtgaacgtgaccttgaccgaggtgtagcccaaccgtgtgaacagactctccagcatggcctgcgtgttctgctgggcgcgctggtccaggccgctcgacttggccgcctcggtgatcttctgttgggccgccgcgtacacccgctgctgtttgtcggtgtcgctgtggaaggcgtcgccgatgctggtcagcagaccgcgatcctcctcgacgacgtagctcttctgcatgtcgagcgcggcctgggactgctgcggcgggggcagggtgagctcgatcgtcttcttctcgttgtcgaccttgagggcgtcaccggagagggcgctgaagtcgacataggtttcgacggtgccggagccgacgaacaggatgcgccgattgaccaggaagtcgggaatgttgtccttgttctgctggaggtcgacgatgacctggaaggtgccgtcggccgcgacgtagcggtgcaggtcgcgcatggactgcagcagcacgggctggctgcggtcggtggtcttgtcggcgaacgggttgtcgaacgagggcagcacgtgcagcgcgcgcaggccgaagcaggacgcgacgatcagggcgaagacgacgccgatgaagatcagcagccgtgcgaagaagctcggcctgtgctcctgcgggacggccggagcacccggctccgcctcctcgggcacggccgggtactccgtcgtcggctcttcgacatccggtgagttggccatgtcctaacggtacggagtgggtacgacatttcgcgaccggagcgcgccccttgacccccctaatgtgaaaaagcgttcagaccggtcaatttctggccgatcgacagttggtggatctccgaggtcccctcgtaggtcagcacgctctccaggttcccggcgtgccgcatgaccggcatctctccgcggatcccgttgccgcccaggatcgtccggcactcccgggcgatcttcaacgcctcccgcacgttgttgagcttcccgatgctcacctgttccggccgcagcggtgcgcccccggcgtcgcgcatccggcccaggtgcaccgcgagcaggaaccccttctgcagttccagtgccatgtcggcgagtttcgcctgggtcagctggaaggcgctgatcggccggccgaactgttcccgcccggcggcgtagtcgagggtcacgtcgaggcagtcccgggccgcgccgagcaccccgaagatgatgctgagccgggcctcggtgaggcaggacagcggcgccatcaggctgcgggcggcgggcagccgggcgctgtccggcagccgcaccccgtcgagggcgagttcgccgacgctggccgcacgcagcgacatggtgtgccggaacgcccgggtggtgagcccgggcgtgtcggtgggcaccacgaacccggcgacgcctttctcggcgcgggcccagatcaccgccacatcggcgatcggcgcgttgaggatccaggttttcaccccgtcgaggatccagtcgtcgccgtcgcggcgggcccgggtggacatcccggtggggtcggagccgtggtcgggctcggcgaggccgaagcagccgatggtccggccggcggcgagcgcgggcagccaccggtccttctggtcgtcggagccgtaccgccagatcgcgtacatcacgagcgagccctggaccgagaccagggagcggatcccggagtcggcggcttccaattccatgcaggccacgccgtacgagatggtggtggccccgggcaggccgtaaccggtcagatgcatgccgaacaatccggccttgccgaattccacggcaagatcgcgaatgggtggatcaccgttctcgtaccactgcgccacgccgggacgaatatgatcgttcgccacctggcgggccagggcgcgggccgcgcggtcgtcgtcggtgagcaggtcgtcaagatccagcaggtcaagcggtcgagcaaccatgcacttcaaagtaacggaggcgtcagccttccacgaccaatacacgagcgtgaatctgattgcgctgttggagcgcggcgcgtaatgcgcggtgcagaccgtcctccagatacagcgcgccctgatactccacgacgtgcgggaaaagatctccgtagaacgtcgaatcctcggcgagcagcttgtccagcgccagctcgcgtttcgtggtgatcagatcggcgagccggatcggccgcggcgggatctccgcccacgctttcagcgtggtgtggtgatcagggtacggggccccgtcccggaccgctttgaagatcacggcggctgcccctccctgctgaaaaaacgagaaacacacgaattgctggtacgagcctagccgcgtcccgaaccgccgcccgctgcccaccggccatgatgcactacctcgtccaccggacggtgaccgcgccggagtgacggtgacctcttgtcgtcccccggatagccgacggtgagcgcccccaccggggtgaactcgtccggcaccccgaacgccgcccggaagtcggcgaccttcgccgccggcagcccgatgaagcaggaggcgagttcctcgttcaccgcggtcaggtgcatcagcagcgcggcgaatccggtgtcgatgtcccagtacggcaccgaccaccgggactcgtcccggtcggcccagcccttgtcgctttccgcataccggtcgagataaacggacttgttcgacagggcgatgatgatcagcggggcggtccgcatccgggcgagccaggcgtcggtgtgctgctcgacagtggtcgccgaccagaagcggtcacagtcgtccggcgaggacaggaccaggaagctccacccctgggcgaagccggccgacggcgcccgcagcccgtgccggacgatcttgtcgatcagttcgggcggcacggggcgcgacacgtcgtacccccggatcatccgccgccggcggatcacctcgtcgaactccatcaggcgcggatcccccacgcggtggtccaggtctcccccggcgccagcgtgaccaggtcgcggccggagcggaacgcgtccggcgggcaggtcatcggctccaccgcgacggaccggcggtgccgctcgccgtgcagcgtgtcaccggagaagacctgccagtacttgaacttctcgtcggcccagaccacgatcttcgcgtccgacgacgggtcggccaggaccacctcggtcagcccgtccgggccgaagtcgatgtcgccgaacgtggtgtccaggatcgcggtgccgatccggcgcggctcggcgtagtcgaactcggtgccggccaccttgaccgcgccgagcggcagcagccggttgtcggccaggatcctggtccgggccggcacggtgagcacggtgtcctcgacgctgacgccgggcaggcgcaggtacgggtgcacggagtagccccacggcgcggcggcgtcgccggtgttcaccacctcctgcgcgcagcgcagcccctcggccgacaccgaccagcgggtccgcagggtgagcggccacgggtagccgacctgggcgggcaggtcgtattccagggtgacggccgaggcggtgtgctcggtggcccgccagcgcgcccagttgaccaggccatggatggcgttgtgccgggccggctcggtgagcgccagctggtaggtctgctcgccgaaggtgtagcgcccgtcccggatccggttcggccagggcgcgaggatctggccggcggaacccggggagatctcgtcgacggagaagccgtccagcagctccaccccgcccgacgagaaactgcgcagcgtgcctccgacctcggccaggacggcgcgccggccatccgcctcgatcgaccactggaccccggatttcgcggctgtctctgtcatacccgcgacactatcgttcggggtcggccacgggatccgggacgggccggtatcgcagcagcgccgggaaggccagcgccaggcccacggccagcaccgcggcgagcaccccgccggccacccaggaggtggtcaccgaggtgaactgggcggtggcaccggcccgcaggtcacccagccggggaccgccggccaccaccacggtgaacacgccctgcagccggccgcgcagccggtccggcgcgaaggtctgcatgatcgtctgccggtagaccgcgctgaccaggtcggccgcgccggccacggcgagcagcagaaccgccagccagagctggtgggccaggccggacagggcgatcgcgatgccccagccgaccaccgcggcggtcagcgcgacaccctggcggcggacccggctgatccagccggaggtgaacccggccagcaccgagccgatcgcgatcgcgctgaacagccagccgaccgccgagctgtcgccgaaccgggtctcggccaccgccgggaacagcgcccgcggcatcgcgaagaccatcgcgatcaggtcgatgccgaaggacagcagcagcaccggctgggtgaccaggaagcgcaggccggccacgatgccgcggaggccggccgtgggcttctccccggcgtcgtccggctcgatcggcgggatggccggcagccgccaggtggcccagaaggtgacggtgaagagcagggcgtcgaccgcgtacgccacggccaccccggtgccggtcgaccagatccccatgatcaggcccgcggccagcgggccgagcaccccaccggccgtcgtggtggtgtagttcagcgtgttcgccgcgggcaccatctcggcggggacgatgcgcgggatgatcgactgccgggccggcgagctgatcgcgaacccgatcgactgcaccgcggtgagcgccaggagcaggtgctcacttcgtacccccgcgatcgcctgcgccagcaggcccagagtgaccacccaggtgagcgcggagctggtcagcagcaggcgccgccggtcgaccacgtcggcgatggcgccgccccagaggccgaagatcagcagcgggaccaggccggcgacgccgagcaggccgacccagaacgacgagtgcgtgatcgcgaacatctgcaccggcacggccaccgcggtgaactggaaaccgaagaacgacgcgccgttgccgacccacatccggcggaacgacgtcacccgcagcggtgtggtgtcgatcatccaggagcgtttcgacttctcctcgaccacgctcacggggccagcctctccacgatccagtcccgctcgacggcgctccggttctcgccgactgcgcgataccgcagccggtcgtgcaggcgactgctgcgtccctgccagaactccacggtctcgggcagcacccgcagaccaccccagtgcggcgggggcggcaccggaccgtcgccgaaccgctcgatcacctcggccaggcgcgcgtcgatcgcctccgggccgggcagcacccgcgactgcgggctggcccacgcgccgagctgggagccgcgcggacgggaggcgaaatactcctcggtctcggcgcgggagacgcgttccaccgccccggtcacgatcacctggcgttgcatcgcaaaccagggaaaaacgacgcttgtgtacgggttgtgccgcacgtccgagcccttgcgcgactcatagttcgtgaaaaacacaaaaccggtcgagtcgtaccccttgagcagcactgtccgggccgacgggcgcccctgggcatccgccgtggccacgatcatcgcgttcggctcgggcagcccggccgcggtcgcgtcggcgaaccaggcggcgaactggtcgctccagtgcccggccagggagccctccagcagcggcgggtgctcggtgtagtcacggcgcatccccgcgggggacggcggatcggcagacatcgggggtacttcctttcggctgcaacgacggtaagacggcgaccgtccggtgtcaggtgaaccaggatgggtgtcaccgagagcacaatcgccacgggtcgaccgggccgttacccgggaggcaggatgaatcactcaccgcagccacgtctcccagggagcgccgtgtccgacttcaagccgggactcgagggcgtcatcgcgttcgagaccgagatcgccgagcccgaccgggacggtggcgcactgcggtatcgcggcgtcgacatcgaggatctgatcggccaggtctccttcggcaacgtctggggtctgctggtggacggccggttcggacccgggctgccgccggccgagccgttcccggtgccggtgcactccggcgacatccgggtcgacgtgcagtccgcggtcgccatgctggccccgtactgggggctcgaccagctgctcgacatcaccgacgagcgggcccgccgggacctggcccgggtctcggtgaccgcgctctcgttcgtcgcccaggcggcccgcgggctggggctgccggccgtcccgcagaaggacatcgacaaggccgagaccatcgtggagcggttcatgcgccggtggcgcggcgagcccgacccgcggcacgtcaaagccgtcgacgcgtacttcatctcggccgccgagcacgggctcaacgcctccaccttcaccacccggatcgtcgcctccaccggcgccgacgtggccgcctgcatctcctccgggatcggcgcgctctccggcccgctgcacggcggggcgcccacccgggtgctgcacatgctggaggcggtcgagcgcagcggcgacgccgagggctatgtgaaggatgtgctggaccgcggcgaccggctgatgggtttcggtcaccgggtctaccgcgccgaggacccgcgggcccgggtgctgcgccggatcgccaaggagctcggcgcgccgcgcttcgaggtggccgccgcgctggaggcggccgcgctgaccgagctgcgggaacgcaagccgaagtgcgagctgtggacgaacgtggacttctggtccgccgtggtgctcgacttcgccgaggtgccggtgcacatgttcacctcgatgttcacctgcgcccgggtggccggctggagcgcgcacatcctggagcagaagaagctcggccggatcctgcgccccggcctgcgctacgtcggcccggagccgcgccggccttccgaggtcgagggctggtcccaactcacgcataatgtgtgatcgtggctgacatccggatccccgacacgatcaaacccgtcgacggccgcttcggctccgggccgagcaaggtccggccggagggtgtcgaggcgctctccgcggtgtcccgcaccttcatgggcacctcccaccggcagcggacggtcaaggaccaggtcgcccggctgcgccgcgggctcgccgagttcttctcgatgcccgaggggtacgaggtggtcctggccaacggcggcaccagcgcgttctgggagatcgccaccttcggcctggtccgggaccgggcgcagttcgccgagttcggcgagttcggcgccaagttcgtgcaggcggtcaccgacgcaccgttcctggctcagcccaccgtgcaccgggccccgggcgggcaggccgcgttcctgaccgccgaggccggcgtcgacgtctacgccaccgtgcagaacgagacctccaccggggtttccgtgccggtccgccgggtcgcgggcgccgacccgggcgcgctgctgctcaccgacgccacgtccggcggcggcagcctcgacgtcgacctgcgcgagaccgacgtctactacctggccccgcagaaggcgctcggctcggacggcgggctctggctggccctgatgtccccggccgcgatcgagcgggccttcgagatcaaggcctcgaagcggtacatcccgcagttcctcgacctggtcaccgcgatcgagcagtcccgcctggaccagacgtacaacacgcccgcgctggccaccgtcttcctggcggccgagcagctggactggatgaacgcacagggcggcctgtcctgggcggtcaaacgcagcgcggagagcgccgcggcgatctacggctgggccgaccggtcgtcgtacgccgagccgttcgtgaccgatccggcactgcgctccgcggcggtcgccacgatcgacttcaccgacggggtggacgccgccacgatcgccaaggtgctgcgcgccaacgacatcgtggacaccgagccgtaccgcaagctgggccgcaaccagctgcggatcgccctctacccgaccgtcgacccgaccgacgtcaccgccctgaccagctgcatcgactacgtggtggaacggctctgacagatacccgcccggtgacttggctcattgcgatcagcgaggcatagtccgtaccaatgggggtagcgaagaatttgaagatcatcttcgctggtcagccagtttgacggcgtggcttacccccaaggagtgaccggggcgcgtaccgtgttccgaaacgcgcccgggtgactgactctcgggagcacaggccaacgcgacgagacggaggcaacgcatgcggccggtacgcttcgtcgccctctccgaggatggacaggccctcgtgctcgccgacgaggtgggccgcctgctggcgctgcccctcgacgaccgggttgccggggtcctcaccgacagccccgcaccgccgagcacggcggtcgcggtgctcgccccggacgtccaggcctcactgtccccgcgggacatccaggcccggatccgctccggcgagtccgccgaggacgtcgcccgggtggccggcgtccccgtcgaccgggtcctccgctacgccggcccggtgctgcaggagcgcgccatgctggcccagcacgcccggcgcacccggctgaagacgtccgactccggccagcccctggccgaggtcgtcgacagccggctcgcccagcacggcatcgacaccgagaagatctcctgggacgcgttccggcgcgaggacggcacctggcggatcgtcgccacctggccgtccggcaaagccaccgcccaggccatctgggacctcgacaagggccgccaggtcgtctccccgcacgacgacatggcgcagtacctgtgcgccgagcgccccacccagatcctcggccaggacccggtccccgagcgcggtggccacggcctgcccggcccggcccgcagcgccgagcccacccgcggcggccacggcctgccccctagctagctagcgacccgatccgcgccggccgcgacgcgctgctcgcctccctcgaccgcccgctggagggctcctccggccgcggcctggagccggtctccccggccgcccgccgcccggtcgccggcggcgccgccgcactgctcggcggcggttccggctccgccttcgacgacgactccgacctccccaaagaggtcccggcggtcccgtccctggctgtcctgcgcccccggcgcaccgtcggccagaccacccagcccggcaccgaaaccgaggagaacaagccccgcaagcgcctcccgagctgggacgatgtcctgttcggcggcggccccgcggcccgcgagtcctcctgaccccgtggcccggccgcgcccctcggcgcggccgcccgcaccctcccgcatcactccccgcggccgccccgcagcttcccgcatcactccggcggccgccccgcacctcccgcatcaccttcccgcggccgcgtcgccgagccttccgctctccccggccccacatcgacccaccccctggcgccgccggtccaccgactcgccggggcggcatcgctccatcgcgttcccgaacgccgtcgctctgctgttcctccccgccgccctgccgctcccccttgtcagcgttgccctgctgttcctccccgccgctccccctgtcaccgtcgccctgctgttcctcccgccgctctgccacgtttccctgtggccgacgccgcgtcgtcctgatgtcacacgccgctccgctacccgttcgaggttcgccctgacccgccttttcgtagccgtcttcccgccgccgccggcccgggacgacctgctccgccgactgccgccggacgcccgttacacgcggccgtcaaaatggcatgtgacgctggccttcctcggcgacgtcgaggaccaccgggtcccggacgtcgccgccgccctgaccaccgtgcccccacgcccggcgttctcgctgcacgctgccgggggcggccgcttcggcccggtgatctgggccggcctcgccggcgacgtgcggccgctggctgacctccgcgagtcggtccgggacgcgctcgccgccgccggtttcgccatcgacccgcggccgttccggccgcacctgacgatctcctaccgctcagcacccggcctgctcgcggcgcttaccgggtacgcgggtccggcctggcaggtgagcgaactggccctggtggagagccgcctcggcaactaccactgccttcagtggttccccgtcagcggcgaccagcacggccccgccccgacatgacgcccgcccaggcgccgtcgctgccaccgatgccggcggccggcaacggctgagcgccgcaaggacggaagcgtcggccgcccgggcaggccggcaggacccggctggtcaacccatcccggcccgggcaagcctgcaagaccggctgatcaccccacaggacccggctggtcaaccagtcccgacccgggcaggcccgcaggaccggctggtcacccgccccggccggcagcaccggctggtcacgtgccccggccattccggacgacctgccaggccgcgcccggggtggtcccggaggctggtcagttgtcctgatggtcgcggaggaccagaccggcggcttcgagccggtcttcgacccggaggcgttcgcactcgcggtcgacgccctgcaagggttgcaggtgttcggcgacgccgagggcgcggcaggccagcaggaggcgggcgtcgtaggcgcgcaggatggcggccaggcaggcctccgaggagcgcaggacgccgctgcgacgttgccggtccaggcggcgcaggtcgtaggccagctgctcgatcggcaccgggggcagtgactccaaccggccggtcaggtcgatgcccggcagttcgcggtcgaggcggcgcaggtcacgggtctgcgggccggggcggcgggcccagtaggccggggcgcccttgcgagggacccggcccggggcggggacccggcggaacgacgagcgccgccggggcaggtggcccgaggtctcgggccggcgctttgcggggcgccggagcaggatccgggcacacggcacgatcagcagcgtcatccacgccgccgagatcacgaccagttgcgccatcgccacactctgacgctaggccgggatcggcccggccggaacacccgttcggcggaactgatctgccaactacctaaatgccagcttccataccgacatcgggcatcctttccggcgtacgagacgggcaaaacccccgatcgggtgacgcggacggtcagacgtgaccggcgggttcgggggcgcgaccggggcggtgcccgcgacgtaccgccatcggtggcacctccggaaggtccgcctccgcaagcggcgcggcctccgcgggcaccgcagggggcgtagcgggagccgggatcagccgcaaccggggccgcggccgcaaccgcacctcgatccgctccccaccggcccgcaactgccaggccagcgccaccccggaggccaggaacgagacgagaccacccacccagatgctggacggcaccccgaagtgcgacccccaccatccggccagggacgccccgatcggtgtggtgccgaggaagaccagcacgtacagcgacatcacccggccgcggtattcggcgtcgacgcccatttggacccggtggttggcggcctgcgccaggtagatggagaagaagccggtggggaccagcagcaccatcgcgacgaggaaggtgggggcgaacccgaccgcgaactcgaacaccccgaaggcgagggcggcgccgatcacccggtacatcccgggccgggtgcggcggccgctgccggccagtgcgccgccgagcgcaccgaccgccagagcggtggtgagcagcccgaacgacgacgccccggcatggaagttgatctttgcgagggcggccagggtgaccgggaagttgaagccgatcatgccgatcaccgccatcaggcagatggtgagcagcaggtcggggcgcttgccgacgtaggtcaggccgtccagcacccgggcgccgccgcgtgccttgcgttcgatgccgagcagttcggcgcggttcatccgggtgtacgtgaagatcggggcgatcaccaggacggtggcgatcaggaacaccacccggatggacaacaccgacagcagcacgccggccatcgccgggccgccgatccgggccgagttgaaggtggccgcggagagggccagcgcgttcggcagcagcggcagctcgacgagctcggagacgaacgcctggcgcaccggtgtctcgaccgagttcgcgatgccgaacagcagggcgaacaggaagacatgccagagctgcacgatgccggaggcgacgatgaccgcgaagctgaccgcggtgaccgcgaacgcggtgttcgccacgatcagcagcttgcgtttgtcgtaccggtcggcgagccgcccgctgtacagggtcagcagcatcaccgggacgaactgcagggcggtgaccaccccgagcgcgctcggcgagttgtgggagaggtccaggaccagccagtcctgggcggtgaacatggtccacacgccgatcagcttgatcagctgaccgacggcgaagaggcgatagttccggactcgcagggatcggaatgtcgtgtccagcactgcccgcatgcggtcgcgcccctcacttcgtcgtacgcgtcatcgtcgtgtgacgaaacggacgacggcgagagccggtcagccgcgggcgacgcgcagcatgatctccgcggcgcgtgccagggtgtcccgttcctcgggggtcagccggtccaactggccggccagccactcgttgcggatgtcctcgttctgcgtatagaccgcgcgaccctcgtcggtggcggccaggatcacctggcgcccgtcggtggggtgcggcgtgcgcgccacgagcccgcggtcctccagcttgccgacgatcttcgtcatcgtcggcggttggacccgctcgacgtcggcgagctcacggggggtgagcgcgccgtgcagctggaggctggtcagcgcggagagctgactgaaggtcagatccccgaccgggcgggcctgacggacccgcctgctgaaccggatgatcgcttcccgcagcgtcttggccagcgatgccgctgtgcgctccgtcgtcatcacccgctccgtcacgatacttagcctagctaatgagcttggctaacgacatggatttacccgtatgaccgccgtcaccgggcacgctaggggacccggtgacggccctgacagctcagaggatccagttctccagcggaccccgggcgaagtacagcacgaagagcacggccaccccgtacaggatggggtgcacctccctcgccctcccggtggcggccttgagcaccacgtacgacaggatgccggcgccgatgccgttcgagatcgaatacgtgaacggcatgatggtgatggtcaggaacgccgggaccgcgatgctccagtcggtccagtcgatctgccgcaccgcggtcatcatcaggaagccgaccaccaccagcgcggtcgacgcggcctcgaacgggaccacctgcaccagcggcgcgaagaacatcgccagcaggaacagcccaccggtgaccaggttcgccacaccggtgcgggcaccctcgccgacgccggacgcgctctccacgaacgaggtgttgctggagacgctcgccgcgccaccggcggccgcggcgagcgagtcgaccagcaggatctcccgcgtcctcggcggcatcccttcgtcgtcgagcagttcaccctcctggccgaccgcgaccatcgtgcccatcgtgtcgaagaagtccgccaccagcagcgtgaagacgaacatcagcgcgaccagccagccgccgtgccgccacgaacccagcacgttgaagtgacccagcagcgacaggtccggcgtgctgaccacctgggccggcatcttcggcacgttcagtgaccagccgtgcggattctgcaccaccgagccgacgtgggcgagcgcctccaccacgatggccagcaccgtgctgcccaggatgccgatcaggatcgcgccgcggaccttgcggacgaacaggatcagcgtgaagatcaggccgatcgcgaagacgagggtcggccaggtcagcagtttgccaccgagacccatctcgaccggcacggtggtgttcgcgacgtccggcacgcggtgcacgaaacccgagtcgaccagtccgatgatcatcaggaacaggccgatgccgaccccgatcgcggtcttcagctgggtcgggaccgcgcggaacaccatcgtccgcaggccggtgagcaccagcaggccgatcagcagaccctcgatcaccaccaggcccatcgcgtcggcccaggtcatctgcggggcgatctcgtaggcgaccagcgcgttcacacccagacccgcggccagcgccagcgggaagcgggccacgacgcccatcaggatggtcatcacaccggcgaccagggcggtgcccgcggcgagcgcggccagcggcaggtgcgcgccggccttgtccgtgccacccgccaggatcagcggattcagaacgacgatgtacgccatggtgaagaacgtgacgaatccgccacggatctcacggctcagcgtcgagccgcgcttggttatctcgaagaagcggtcgaacccgctccgcgcagtagtttctgcggttgtggacatgctggcccttccgggtggcacagtgacgtcgcgcgcatgctttcagacagcatgacctcggcaaaagccgaacgatgttacaactctcacgtcctgcgccgagagggtcgaaaatagccttaccctgacggggtgagtgacctgtctcccggtctgagcgtcgtcaccggctcgaaaccacgacccgagccgctggacccgccgatggtcccgttcgcgctcgccggcctggccgcgttcgccgtcgccgcgctcatctgcctgctggccggcgcgcccgaccgctggctgcacaccagcgtggccgggttcctggtcggcatcccgggcctgatcacgatgatcgtccacgaccggaaccggaagcgccgccgggcgctctcccacgcggagttccgcgagatctcctagaccggccgccgcatccctacaacgtcgcggcgaggtcgtcgccgagcggtgtgcgctcgtagtagacggcacggccgctgcgccggcccaccaccaccccggcgtcgcgcagcgccgcgagatgcccggagaccgtgccgagggacaccccgagcagcgccgccagctgcgacggcgtgctcgcgtcggccaacgcgccgaggacccgggcgcggcccccaccgatcagccgggcgaccccgccggtcgcggcccgcacctccgccagggcgccccgggccggatacaccagcgccaggcgcggcggcgcctcgcacatccactgtccgacggtcccggtgtgcggcaccagcaccaggccgtgttcgccgacattcagatcggcgtaggtctgcagggagaagaagatcgcatcgggcgccgcccagcggatcttgcccatcccgctgagcgcgtcccgccagccgcgggtcgcgagcaccccggcccggtgccggatgtcgcgctccatcacggcccgccggcgcggccagtccggctcgacgaaccattcccagatccgggcgaacaccgctgcggcccgggtggtgacaccgtcgacgtcggcccactgcagatcgttggtcttccaggcgtaccggccggactcggcgatcgtcgcccgggccgccgcgtccggcagcagcgcgcgcatctccgccagctcgtcctcgatccgggtggtcatcgacgtgggtgggatcgccacgaagtccggcaggtacttcgtcgccgagatcagccggaccaggcccgcggcgaacgggtcgtcggcgagccacccggccagcgcccgcgcctgggcgcccggccgcccgccgtcctgctcccgccgcaggacgaccagccggctgaacgtctcggcgagcggcgagagcgcgaaccggctggcccgcagcgcctccggtccgagacggatctgcgtcatggcacgaccttgcggcaatcgccgcaggaatgcaaacccgcggccgtacgggatgacgatgctcgccgtgaccagcgacctttccgccgccccggtgcggcgactgctgagcggccggttcggatggttcctcgcgggtcgggccgtcgacatcttcggcacctcgatgacgacggtcgcgctgtccctgggcgtgctccaggcctccggccgggccaccgacctgggcgtcgtgctcgccaccagcatggtccccacgctggtgctgctgctcgccggcggtgtcctggccgaccgcaccagccgccgtgggctgctcatcgccgccaacgcggtcagcgcggcggccgtcggcgggatcgccgtcgtgctgatcaccggccgctaccacctcgggacggtcgccgggctgtccctggtcagcggggctgccaccgcgttcgcgtcaccggccctgcgcgggatcgtccccgagctcgtcgacgacgctgacctgcagcgggccaacgcgctgctgtccggcaccaggaacggcacccggatcatcgccccggccgtggccggcctgctcaccgtcaccgccggcgggggttgggcgctggccgccgacgcggccagctgtctcgtggcggcggcgctgttcctgcgcttgccgcccgggagccggaccgccgccaccgcacccgggctgggcgccgacttcgcgaccggctggcgggtcttccgctcgatgcgctgggtgatgctgaccagcttctcgtacgcactggtcaacgcgttcgccgtcggcccgtggaacgtgctcggcccgacgatcgtcgccgcgcacgggggcgcgttcggctggggcgcggtgctgtcggtacgcgcggccgggctgttggcgaccagcctggtcgcggtcaagctggtgttccggcgaccgctgcggaccggactgctgctcggcgtcacgtccgcgtccccgttgctggccctcgggctgtccggcgaggcgtggaccgtggccggggcggccttcgtgggtggcatcgggttcacgatcgcgggcgtcacctgggacaccgcgctgcagacccgggtaccgcgggaggcgctgtcccgggtttcgtcgttcgacgacctgttctcgttcatcgcgatcccgttgtcacaggtcgcgatgggaccgctcgccgcggcggcgggcgcgggccgggtggtcgtggtgtgcggcgtggcctacgtcggcgcgtgcctgctcccgttcctgagcccggagatccgccgcggctagcgcgtcgggccaccagcacgccacgccccagccgtggccggcacgccacgccctagctgtggccgaagtcctcggcgggctcgcccgactcgaccgagccgtggccgcggctgaccgccaccgcctccacctcgctgtcgtcatagatcgtcggcagctcgtcgaccggctgctcggtgccggccagcagcgcttccgaatgcgcgccgcaaccgtggtcggcgctgaccgcacggccgtcgtccggcgcgtacaggttgccgcagacaccgaacatctgccgcagcgtgccggccagcggcaggtagaaaccgcaggtgccgcagcgcgcgttccgcggggcggcggtggagatcggcgcctccggaccggcgtcgccgtcataccaccgctgggcggtctccatccggccgtccttggacatcacccgggaccggcccaggccgagctcccaggagacctcctcgaccgcggcgtcgtcgctgagcacgtagccgggggtgagccggtcgtcgtccggcgcggtcggcatcaggtcgccgacacccaggtcgccgggctggacccgctcgttccacgggacccagccgggggccatcaacgcgtccggcccgggcagcagcaccgtctcgcagatcgtcacgtgccggctgcggggcacccgggtcaccgtgaccgcccagcgccagccgcggtaaccggccaggtgggactcgaagaagtgagtcacgacacgatcgccctcggcgatcgcctccaggtgctcaccgatgtcggtcgggtccacatcggtgatcgcgccacgggccacccccacggcatcggcacagacctggtcgagtcgggcggcgcgggcgacagtcctggaggtcacccgcccattgttgcctactcggagggatagctcgcaacgagtccccagatgcggggtcgcccggatcagtcaggatggttgccatgccgttgcttcccactctcggacgcaccgtcggcaccggtgtgaaggcggtccgcgtcgtcgtgcgcggctgcgtgcgcggcacggcctgggccacccggcgggtcggcacgatccgggcccgcggcgcggccggcgagatcggcatgatccgactcttcgacctgcacgcggtctcctgcgccggcgacgcgctgatcgcgatcgggctggccggcaccatcttcagcgttccgctcggcgaggcccgcggcaaggtggcgctctacctgctgatcaccatggtgccgttcgcgctgctggcgccggtcgtcggcccgctgctcgaccatttccggcacggccggcggtacgcgctggcggtcaccatgctcggccgggcgttcctggcctacgtgatgtccgatcacctggccggctgggcgctctatccggcggcgttcggggtgctcgcgctgtcccgggcgtacggggtggcccgatcggcggccgtgccgcgcctgctgcccgacggggtcggactgtcccaggtgggcgcgcgggccagcgtctacggcacgttcgccggggcggtggtcgccccgatcggcctgctcgccttccggttcggcccacagtggccgatgcgggtcgccaccctgatcttcatcgtcggcatggtgatcgcgctgcggctgccgccgcgcgccgactccgacccgccggaagccatgccgcgcgcctggcgcaccctgctcggcctgggccgcggcccggaccgcccgctctccggccggctcatcctggccaccctggtcggcagcgccggcctgcgcctgctctacggctacctgctgctcttcctgaccttcgcgatcatggccggggacgtcggcaccggcatcctcggcctgaccgtcggcaacggcaccgcggtcggcatcgtcggcggcgccctggccctcggcacgttcctgtccaccgcggccggcaccggcctgcacatccgccgcccgctcgccctgcaagccggcggcctgatggtcaccgccggcgccgcggtcctcgccgccgtcgtcgccaacctggccaccatcaccctgctggcgctgctcgccgccaccttcagcggcatcgcgaaactcgccgtcgacgccaccatccaggaacgcgtcccggaacgcctgcgcgccaccgccttcgcccactcggaaaccgtcctgatgctcgcctgggtcaccggcggcggcctcggcctgatcccgctcaccggccgcctcggtatcgccctcgccgcgctgctggcgagcctggccgcggcccgcgccggctggtccgcggcccggctccgcggcgaacggttgtccggccggtccgggttcgccgaggacaaccccggcgatccggtcgcggtctccggagacggccgattcgccggtacgccggaagcccccaccaccgcgcccatcccgcccgccccgcggccgtccgccacccacccggaccggcccgccgggcggctcgacgacgaggcggtgttcgacgaggcggccgacccctggccggacgccccgacggtgcccgaccaggccggccacaacccgccggtccagcgccgcaccacccggcccggcccgcccgacgtcgatacccggccgagcgccacgggccccggcacccgcgaccacgacacccggcagagcaccacggggccgggcgcccgtgaccacgacgtccccgccggcccacgcgcggagcatccgctggacacgacgctcgtggacgagccgggccaccgtcgctggtggtcccgccgcaggcccgcgaagaagccgaccaccccgccgcccgcctccccgggcgttccggagccgacgcagcagttcccgaccgaggccccgcccggcccgtccccggcaccgcccggctatcacgtctaccggccctcctcggccggcccgtccaccgggaacggcgactccgaaagcagcgacaacgcgtgaacccgctcctgctcgtcaccgcggtgcccgccgaggccgacgccctccgcgccgccctcggcccggccgccaccgccgcgggccacaccaccaccgccgccggccccgggtccaccgccgcgggccacaccaccaccgccgaccccgggtccaccgacgcggcccactccaccgcggatccccacgcgatgcccgatccggctgccgtgccgggccggggcgggggcgcggatccccattcgcttgcggtcgtcgtcgaggcggtcggcgtcgggcccgcggcggccgcggccggtaccgcccggctgctcgcccggcgcccctaccgcgcggtgatcagcgtcggcatcgccggtggcttcccgggccgcgccgcggtcggcgacaccgtcctggccgcccgcacgatcgccgccgacctgggcgccgaatcgccgagcggtttcctgccgatcgaggagttgggcttcggcagcagcaccctgacgatcgatgctgagctgctgcaatcgttgcgggccgcacttccgcacgcgatcaccggcgacatcctcacgctgagcacggtcaccggcaccgcggcgaccaccgcccggctggcgacccgtttcccgcaggcggtcgccgaagccatggagggctacggcgtggcgatcgccgccgccgcggccgccgtcccgttcgccgaactccgcacgatctccaacccgatcggcccccgcgaccgcgccgcctggcgcctggccgacgcgttcgccgccctgcgagccgccgcccccgccctgctcaccctcccctgaccgccgcccaccggcagcgtcgaaccgacgcggaaacggcaccggcctgcggcgcggaccggcctgaacccgccgcgcgaggccgccggtgccgagccgaagaacccggcagcgcggaaccggcgggcacctgcggcatagagccggcgagaccggggacgcgggacccgcgggaccaccttgagccgggaaaggggcggaccacctcgacccgtcgacccgtcccggatgccgcccagcgatctcgcggcgggctcacctcgccgaatgagaacggggctcgcaccttgcggttgtcgtgggcaggacaccgtacaaaggcatctgatatttcgcggcaggaaaccgcgccgcgcccagcgaccgcccccagaattttcccgcgatgacaaccggtaatcaacgatcggccagaagtaaccgcacaccgtccgccttgccgcaaatgtcggccaaccgggcacgaaaaggtgaattcttttacaggaatctgttgctgttgatgatcgggcccggcatgctgcgctgaacggccatgtgacccacgtcgctgtcatcaccgagcgctccgggtcgatcggaaacgggatgctgagcgaggcacgatggacgagatgagcgccgcggcgcgggcccgtttgatcggtgccggctacgccgcccaggggctgggttatgcggcgatcgtcaccgccctgcccgcgttcaaggaccggcagcacctgaccgacggcaaggtttccgcgatcctgctgttcgtctgtgtgaccgcggcgctcggctcggtggtcgccgatcagttggcggcccgctggggcagccggcatgcgctggccggcggtctgttcctggtcggcgccgggttggccgcgaccctggtcggcacgccgaccgtgctcttcgtgacgatccttctgctgtacggggtgggtctcggcatcgtcgacgcctcgctgagcatgcagggggtgctggttcaggcccgcctggggcgcagtgtgatgagccggctgttcgccgcgtacaccgccgccgcgatcgtcgccgccctgctcatgtcgtggtcgctggacaggcatcacggggcgacggtgccgctgggcgccgcggccggctacgccgtgctggtcggcctggccggctggcgcgctttcgaacccggccgcaccgaacgctccagtgccgtccacgacaccggcagccgcgccgtccgccgggtcgtggtggtctgcggcatgctgatcttcacggcgttcctggtggattcggcggtcagcacgtggagttcggtctacctgaaggacagcctgcattcgcgggccgccatggtgccgatcggctacgccgcgtaccaggcgacggtcctggtcagccggctggtcgccgatcacctggtgccccgggccggccggctgacgatggcggtcggtgcgctggcggtctccggggtcggctgcgccctggtcgtcctgctgccgtcgacggccgccgcgatcgccgggttcacggtcgccgggatcggggtgggggtgctggtcccgctggccttctcggcggcgggtgaggcggccgcggagagcagcgacgaggtgatcgcgcgggtcaacctgttcaactacgggggcgccctggtgggggcggtcctgctgggggcgctgtcggagccgatcgggctgcggatcgcgttcctcatcccggtcgccggggtgatcttcacggtgccgctggcccggcagctgctgcacctgacgccggcgccggcaccgcgcccggctccctgaacgagcgccaggcccgcggctggcaccgcaccggccgcctctcgcggccggctcggcttcccctgttcggcgcgtacgccgtgagcggccccgccccgggcggtggataggctggacgggtgccgaggctggtcgaccatgaggtgcgcagggcagagttgttcgcggcgacctggcgggtggtgcgggcgcgcggggtcgacgggacgacgacccgggcgatcgccgacgaggccgggtgttcgctgagcgtgctggcgcatttcctcggcggcaaggacgacattctggtggcggctcagcgggcggtctacgaccggatcgtggagcgggccttccgcatcggcggggatctcctcgggttggcggcgttgcgcacggcgctggacgcggtgctgccgatcgacgaggagcgggcggccgacgcgcacgtgaatgtggctttcgccggggcggcgttgtcgcatccgctgctggccgagtcgcggcgggggtcacaccgggtgatccggatgcatctgcggacctgcctgcgggaggcccgcgagctgcgggagctgagggccggcgtcgaggatgaggcggtcatcgacgacttcatcatcctggtggagggcagcacgctgctcagcctggtggacggctgggccgaggagggccgggcggaacgcctgacccgcctcgccgacgccttcgtcaaccagctgcggtcacccggccgcggctgacctgatcaggtcgcgataccagtaccaggagtccttgcgggtccgggcctgcgtctcccggtcgacgtagacgagcccgaaccgctcgtcgtagccggccgcccattcgaaattgtcgaacgccgaccacacgtagtagccctgcaccggcgccccggcctcgatcgccgccgccaccgcctccagatgcgcctgcaggtaggcgatccgccgcggatcccccacccgcccgtcctcgccgggcggcccgtcgtggaacgacgccccgttctcggtgacgatgaccgggggcagcaatggataccgctctttcagcgtcaccaggatttcggtcaacgccgccggcacgatcgcccagccgaagtcggtgcgctcgtcgcttttcaccggcaccggcgagaacggcattccttccgggatgtcgacttcgagaatgccggaatagtccttgccctcccgcggcgcttcgatcgccgtcggttcgtagaagttcacgccgtagaagtcgagcggcgccccgatcagcgccaggtcccggtcgagttgcgtctcctcgacgcccaccccggcgcggatcatctcgtccgggtagtcgccgagcaggatcgggtcggagaaggtccagttggtcaggtcgcggaacatgtcggcggcgacggcgtcggccggatcgtcggacgccgcgtacaccgggaagtgctggttggcgatgccgaccgcgccggcgtcgtgggcgcgcagcacctgtaccgcgagcccgtgggcgagcagctggtgatgcgcgacgggcagcgcttcgagcccgagtccgcggcccggggcgtgcgaggtcaacccgtacccgtaaagggtctggacgctcatctcgttcatcgtgatccagtgccggacccggtcgccgaggcgcagcgcgaccgtgccggcgtagtcggcgagccgatgggcggtgtcccgggtcagccagccgccccggtcctcgaggtcctgcggcaggtcccagtggtacagcgtggggaccggccgcaccccggcggcgagcagttcgtcgaccagccggtcgtagaagccggggtcggccagcgcccgcgtccaggagatcgagaagcggtagtcgtgcacaccggcgtccgcgatgtggccgacgtcttcggcataccggtgatagtggtcgatggcgacccggccgtcctcgccgtgtcgcacccgccccggttgcgcggtgaacgtgtcccagatcgagggggctttgccgccggcgtcggcagcgccctcgatctggtaggccgaggtggccatgccgaaccggaagccgggtgggaaacgcatgctggttcctttcaggacagtgcttcgagccggggcaggcaggccagtgcgagcagcgcgacggccgcggtgaacaggtacagggtgggatatccgccgagccgggtgacgatcggcgcggcgatcaccggggcgagcagctgcggcagggtgccggcgatgttggcgacgccgagcatggtggcccgggtctcggcgtccggcaacacgtgcgtgatcaccgccatgtcgaccgcgacgtacgccccccagccggccccgaccagcaccgacgccaggatcgccacggcgaccacggggatcagggcgagcagtacggtgccggcggccaggatcaccgcggccgccgcgacgaagatccggcggcgttcccaccggtcggagagcaccccgccggcgaagccgaagatcccggcgaagaccacgttgaccacggtgaggatgagcacccaggtggccgcgtcgccgaccccgacccggtcggagaggtagtagaagagatagaccagcaccagcgcgttgaccaggttgagcaggaagcggatcaaccaggcccaggcgaacggggcgcccggccgcagcagcgccgaccagcgcaccgcggtccggtccgggaccagcaccggctcccggtggatgagcagcagggcggcgccgagggcgggcaccgcgacggccaccgccaggtatccgccgctcgcgacggccagggcggtgcccagcacgaccccgacgatctgggcgacgccgaacagcgcgccgaccgtgccgcgctggcgttccggcacgcggtcgccgatcatcgcggccagcgcggcgagcggtccgttcagtcccacctggaccagcacccaacccacgatcatggtggtacgggtgtccgccgcggccaggacgagaagccccgccacgccgatcaccgtgccggccacgaagatcggccggcgcgagcccatccggtcggagaccgcgccccagatcgggttggcgaccagcgaggcggccgccccgaccgcggtgaccagggcgagcagcgcctccttgccgccgccggtggcctccgcgagccgagcggcctgctcgggcagcaggatctggatcggcccgaaccaaccggccgccaccccgatcatggccagcgcgtacgcgaccatccagcgcgtacgcaccggcacttcagtgatcgtcatggacgggctttctcccacatctcgacgtacgcctcggcgccctgcatcagttgcgcccgcagcttggcccgatccgggccggcctgctggaccaggtcggtgatccagtcggcgtacagcccgtactgcgccacgccgtcggtgttcaggtcgaacgtgcgggtcccccacacctggcggttgatggtggtgccattcagcccggcgaacgggtaggtgagcgggccggcgccggcggtcagccgcggggcggcctgggtgccgaggccgttcacgtcggtgcccaccccgtacccgacgatccggttgccgttggggagtgcgttgttggcccgccactcgtcgaggaacgtgccggtgccctggccgtcgtcggtggccgcgaaggcgtaaccggccacgaagccgccggcctgcagcacccggtcgaccagggcccggtcggcccagctgtgcaccgaggtgacccccgggtaaccggcctgcacggccatgtcgagcacgtcgttcgcggtcttcacgctcatgtggtcgatgtggatgatcaggccgcggtcgatcatcttctggatcaggtaacggccgatggtggtcagcccgcgggtgttgcagatcttgccgctggggtagacgggcaggatcgtgccggccggcagcccgacgccgaggctgagcagcttggccaggtcgtcactgaccagcggctgatcattgtcggacgggccggtgcagctggtcgcctgccaccagtgcccgctggagagcaactggccgacgttgatcgcggcgccggtgagcccggagtcgaaccgggtgccgccgaacgcgttgtcgaacttgtgcaccgggtagaagccgctgacccccatgccctgcagctcgtcgagaccccggtcgatgtccgcggtggtgcactgcggcacgtcccggatctcccggcagccgaagatctccgagttctccaccccgatggtgaccgcgagtctgccctgcgcggcgatcgcgcggacctcggccggcgtggtggccagccggaaccagcccttgcccggcccgccgctgcgcgcgtcgatgtagtcctgcatccggcgcagataggtggactgggcccggatctggtccatctcgtcgcaggaggtgtgcaccggggtcagctcacagatcacccggttcgccaccagcagcacgttgagcacccgctggccggactgccaggcacgttccaggctgcggaagtaggacgcctcgtgcagctcggtgtcgtgctgcggccagtcggtgaacgacggccagccctgttcggaggagttgatcggatcggtgcccgcgatgatcgcctcgagcagcgcgccccagccgagggtggcgtgcgacgggcagccggccagcgcgaccggggcgccgccggccgcataggcgtcaccgcagtgcagggatccgccgaacgcctcgccggcggtgatgtgcgcgtgcgcgtcgatccagccgacgagtttgccgtcggcgccgacggagggtcccggggtgccgcccaccccggtggcgatgtccgggatcgcggcgcaaccggtggccggggtgagcgccatggtggcactgccggcgccgagtccgcccaggtagcggcccatctgctgaccggtcgcggtgctgaccagccggtagcgcccggtggcggagctgaccgtccagtcggcccggtcgccgtacgagtcgccggcccacacccagccgagcatgctctggtacggcggcgcgccggtgtggtcgcgcagcacgtaccggccgagctgggtggcctcgaaccggaacggctcggccttggcggcggtgccggtgaagccgtagccgaccgagtccttgaagacgtagccgagcggagtcgatccgttgaacgcctggagggtgacgcacgcgccctccaggtcgttggcgggcgtccaggtcaccgcggcttcggcgggcgcggacagcccaccggtgaggccgagcaccaggacgcccgcgagcagtctgcgacgcacggggcacccccttggtagatcaaatgatccgacaaggcggagtgtagaaattcacaccgtgttaaagccagaggtgaatgtgaatatttttccggggagccatatgcggcgtctccgaggcaggggctagcgtgaatgccgtggcgctctcgctcgcggtctccccgtgccccaacgacaccttcgtcttccacgcgctgatccacggcctggtccccggcgcgcctgcggtcgacctgaccttcgccgacgtcgacgtcaccaacacggccgccgagcagggcgcattcgacctggtcaaggtgagttacgcggcgctgccgtggctgctcggcgactatgagctgctgccctgcggaggcgccctgggccggggctgcggcccgctggtgctgacccgcgacgggcgcaccgacctgaccggcgccaccgtggccgtgcccggcgaccgcaccacggcctacctgttgatgcgcctctggtccgccgagcacccgccggcccggatcgaggtcgtcccgttccaccagatcatgcccggggtggccgccggcacgtgggacgccggcctggtcatccacgaggcccggttcacctaccagcggtacgggttgaccgcgctggccgatctcggcgagtggtgggaatcggacaccggcctgcccattccgctcggtgcgatcctcgccaagcggggcgtcgtcgaccccgccgcggccaccgggtggatccgggactcactgcgccagggctggctcgacccggccgccagccaggacttcatcctggccaacgcgcaggagatggagccggccgtggtccgccagcacatcgagctctacgtcaacgagttcaccctggatctgggcaaggacggactcgccgccgccgacgccctgctcggacgcgcggcggcggcgggtctcacgccagcggtgccgtcgtttctctagagctcgaactcgcgggcgaccgcgtgcatcagctgcgcgatcttggccgcggtcttcttgtccgggtaacggccacgctgcagcacgggctgcacggtgttctccaggaccttgatcatgtcctcgatcatgctggccgtctcctcggccgggcggcggcgcgcctcggcgtcgcgcagcgccagcgacggcggcgcgtccagcagtttcacgccgagcgcctgggcgcccttgcggctgtccacgacgccgaactcgatccgctgtcccgttttcaggtcggcgacccccgccggcagcgcacccttgggcaggaacacgtcgccgccctcatcactggtgacgaatccgaatcccttcgtcgcgtcgtaccacttcactcgacccgtgggcaccgctgacctcaacttcactcaatggacacaactgctcacggggagcctatccagccgcggccccggacccaactgcaatctcctccagccgggccgggaagccgggcaagccggacagaaagtacgtgttcgccgcctcgtgcccaggtcggagccgaccgggccggatcagtgcgtctgcgactccggcaggctgcgcaggcgctccagcggcagcgggaagctctggtcgtcgccgaacggcgacggggcggcggcccggtccgagaccagctcggaaacctggaggtgccccttcagagccgggctctcctgcttcttggccttcgacgccacgttccgtcctcctcctgaaagaggtccggccacgcccggacccgtcaccatcgtcccatgaacgttagcgttgaagacgatggccaccacatttgcggatcaactccggtcgctgcccgacgaggcgctgggcgcgctccttcagctgcgccctgacctggtcgttccggtgcccgccgacatctcggcgctggccgtgcgcgcgcagtcgcgcggctcggtcgcccgctgcctggacgggctggacgagttcaccctgaccatcctcgacgccgcgcgggtcacccgatccgcggacaccgccctcacctcggtcgacgccatcgtggagctggcctccggggtggccgccgacgacgtgcgggtggcggtcgaccggctgcgggtccggttcctgctgcacggcccgccggaggcgctgcaggtggtcgccgcggtcgacgaggtcacctcgccgtatccggccggcctgggacgcccggccgactatctggacgcgcacgccgccgcgctggtcgccgaccgggcgagaatgcgccgcaccgtcctcgccgcgccgcccggcgcccgcgcggtgctggaccggctggccgccggcccgccggtcggttcgctggcccgggacgccgtcgccgagccgatccgatggctggtcgaccagcacatcctggtgcccatctcggaggccggccgcgctccccgcccggatggcgacctggtcgagctgccccgcgaggtgggcctgctgctgcgccgcgagtcgggcccgctgggtccgctgcggccgttcccgccgctgccgcaggcaccggtgcgcgacgcgaaggcggtcgactcggccggcgccgggcagaccatggaggcggtgcgcgcggtcgaggcggtcctggaggcgctcgccgccgagccggccccggtgctcaagaccggcgggctcggcgtgcgcgacctgaaacggctggcccgggtggccggggtggacgaggccggcgcggcgctgctcgtcgaggtggcctacgcggccgggctgctcggcgagtcggagacgtcggcgcaccgggtgcccggcgcggtgcaggacatcttcctgccgaccggggcgtacgacctgtggcgcgcggccggcatggcgcaccgctgggccacgctggcccgcgcctggctgctgatgacccggcagcccggcctggtcggccggcgcgacgagcgggaccggccgatcaacgcgctcgccccggacgccgaacgggccggcgccccgcaggcccggcgggaggcgctggacgcgctggccgacctggaaccgggcgcggcgccggcggtggacgatctgctggcgctgctggcgtggcaggcgccccgccgggcccggggacgcgagctggggcaccgcgacgggtgtgccggggcggctctgctcggggtgaccggcctgggggcgctcacgtcgtacggccggttgctgatcagcgcccccgagctgaccgagagtgacccgctgggtctgcaccccgaggagacgcccgcggacgccgtccgcgccctcgacgtgctgctgcccgcaccggtcgaccacgtgctggtgcaggcggacctgacggtggtggtgcccggcccgccggaaccggagctcgccgccgagctcgacgtgatcgccgagcccgagtcggtcggtggggccagcgtcttccgggtcaccccggccagcgtgcgccgggccctggacgtcggttacaccgccgccgatttgcacgcggtgttccgccgccgatcgcgcaccccggtcccgcagaccctggagtatctgatcgacgatgccgcccgcaggcacggcgggctgcgcagcggctccgccggatcctatctgcgcagcgacgacgaggcgctgatcgccgaggtgctcgccgatcgccgggtgaccggtctggacctgcgccggatcgcgccgaccgtgctggtcagccctcgcccggtggcccggctgctgggtgccctgcgcgaggccgggttcgccccggtcgccgaggacgccggcggcgcggccgtgctgacccggcccaaagcgcggctagctagctagccggggtggtcgagcaactgcggcgcggggacatcgcgacccgggcggcccggcgggcgccggtgaccgtgcgggccgcgcagggccaggcggtgcccgggctgaccgcggtgcagcagcacagccaggcgatggcggtgctgcagcaggcggtccgggaccgggcgaaggtctgggtggggtacgtcgactcccacggcgccacgctgtcccgcctggtccggccggtgtcgctgagcgccggctacctgcgcgccgaggacgaacgcggcgagaacacccacacgttcgcgctgcaccggatcaccgcggcggtcaccgaggagtaggcgggcggtcgtgatcgcccccgtggcaacacgacctgccccccatacacacggctgaacccgccggaacgttgcagccggaattccgtggcagactggagggtcgcctttttaccggaggttgtgcgtgaacggcggaccgctgatcgttcagtcggacaagaccctgctccttgaagtcgatcacccggatgcccaggcctgccggatggcgatcgcgccgttcgccgagctggagcgctccccggagcacgtgcacacgtaccggctgaccccgctcggcctgtggaactcgcgggccgccgggcacgacgccgagagcgtcgtcgacgccctgatcacatattcgcgatacccggtgccccacgccctgctcgtcgacgtcgccgagacgatggaccgctacggccggctgcaactgctcaacgacccggtgcacggcctggtcctgcgggggctcgacaggatcgtgctgctcgaggtgtcgaaatcgaagaagctggccggcatgctcggcgcccggctcgacgacgagaccatcgcggtgcacgcctccgagcgtggccggctcaagcaggcgctgctcaagctcggctggccggccgaggacctggccggttacgtcgacggcgaggcgcacccgatcgagctgagacaggacggctggaccctccggtcgtaccagcaggaggcggtcgacgggttctgggccggcggctccggcgtcgtggtgctgccctgcggcgcgggcaagaccctggtcggcgcggcggcgatggccaccgccaaggcgaccacgctgatcctggtcaccaacacggtggccggccggcagtggaaacgcgaactgatcgcccgcaccacgctcaccgaggaggagatcggcgagtacagcggcgaacgcaaggagatccgcccggtcaccatcgccacctaccaggtgctgaccgcccgccggggcggcaacttcacccacctcgacctgttcggcgcccgcgactggggcctggtcgtctacgacgaggtgcacctgctgcccgcgccgatcttccggttcaccgccgacctgcaggcccgccgccggctggggctgaccgccaccctggtccgcgaggacggccgggagggcgacgtgttctcgctgatcggcccgaaacgctacgacgccccgtggaaggacatcgaggcgcagggctggatcgcccccgccgagtgcgtcgaggtccgcgtcacgctcaccgagcaggagcggatggcgtacgcggtgaccgacgccgaggagcgctacaaggcggccgccaccgcccgcaccaagctgcccgtggtcaaggccctggtcgcccggcacccgcaggagcaggtgctggtcatcggcggcttcctggaccagctgcacaccctcggcgagtacctggacgccccgatcgtcgagggctccaccagcaacaaggagcgggagcggctgttcgacgcgttccgctccggtgagctgcgcaccctggtgctgtccaaggtcggcaacttctccatcgacctgcccgaggcggcggtggcgatccaggtctccggcaccttcggctcccggcaggaggaggcgcagcgcctcgggcgggtgctgcggcccaagggcgacgggcggcaggcgcacttctactcggtggtgtcccgcgacaccatcgacaccgagtacgccgcgcaccggcagcgcttcctggccgagcagggctacgcctacaccatcgtcgacgccgacgacgttctccaggtggactaggccgccgtcacggtggcgggcgccggcgtcctcccgaccgacgactggggcgtcggtcggggtcgccggtgccggcgtcggccggaccaacgactggggcgtcggtcggggtcgccggcgccggcgtcggccggaccgacggctaaggcgtcgacggggtggtcggcgtcgccggggtggcctggaccggggtggtcaccgccggcgggctgtcctgcgtgctccggctcaccatcagggcgccggccaggcagaggaccagcatcacgccgaccgcggccagcgctccgaagagccacaggagccgcggcggtcgagccgtccggggcgccggcggtggggcggcgaacgacggagcggcgaacggcggcggcgcgacgaacggcggcgggacggatgcggtgcgcggcgtccccgcgccggcctcctcgtaggcggcggccgccaccacctcggggctgcccagccgctcgaggatctcgatcagctcggcctccgaccgcacgtcccggtcggtccgctcggtggcgatgtgcgcggccagatcggccagcaactcgcggcgctgcagcaggggcaggccgctcaaccgcaggtccacctcgtgcaggtattcaccgaccaggtcggtctggttgggtttcatgcgactccaccggtccccacgagacggtcgacggtctgacggaacggcacccactcggtgcggaaattctcgagcgcggacttcccggacggggtgaggctgtagtagcgccggggcgggccgctgggcgactccgcccacttgctgtccagcatgccgccgcggcgaagccgggacagcagcggatagatcgtcccctcggtcgcggcgagggactgctcctcggcgagccgccggacgatctcggtgccgtaccgatcctcgaactccaccatcgcgagcacgcaaaattcgagcgttccgcgcttgagcccggacgccagctgcgctgcctctcccatgcacgacagagtaccttgcgccgcaaggtatcgaaatccgcgcgccggcgatgttctcgatcaccgtgctggggcgggggcggcccaccggccgcatccgcgtcgtcgcaggtcaaacggcagcgggtcgacctgcggccgatggtcagccagccgcagccggtcagtcggtcagtcggtcacagtcagccagacagccagacagtcggtcagccggccgcagtcagtcagccggccgcggtcagtcagccggtcaccgtcggtcagccggccgcggccgccgcgcggccttcggcgccggccgcccactccgcgtcggccgcctccttgagtgccaccccgtgctccccgtcgtaccggacgaacctgggcagcgccgcggccagcgccaggctgccggccacgcagagcgcgccgcccacccagatcgacccgcccaccccgagcgaggtgcgcgccatcagcccggagcggagctggcccagcagcggcccggtggtgtacgacagcatctcgatcccgccgagccgtccgcgcaggtggtcggggatggtctgattccagatgatcatccggaagaggccggagaccatgtccgccgccccggcgaaggccaggcagaacagggtcagccagagcatgtgggacaggcccacgccgacgatcccgacgccccagagcgcggccgcgatgatcaccatgaggccgtgccggtgcacccgggcggtccagccggagccgaccgtggcgatcagcgagccgaccgccggcgcggcgtagagcaggccgagcacctgcgggccgccgagccgttcggccaggaacgggtagagcgcggacggcatgccgaagaacatcgcgttgatgtcgaccaggtaggtgccgagcagttcgggccgcgacccggcgtagcgcagcccgtcggccacgctgcgcagcgacgggcggtccgcctcggcgggcggcgggacggccttgaccatggtcagacagaccagtgagacggcgaaggtgaacaggtcgaacaggtagacccagtgcaggtcgagggcggcgatcagcagcccggccagggacggaccgatcagctgggcgaactgcatgctcagtgactgcagggccatcgcggccggcagttcgtcggagcgcaccagccggggcagcatggcgctcatcgccggccgttgcagcccggccaccgcggcggtgaggaacgcgcagacgtagagcggccacagccgcggcgtgtcggacagcgagttgaccagcagcaggccgcagatcagcgcgagcgcggcctcactgccccggaccagcagccgccggtcgaggtagtcggcgagcgccccgccgacgaacgccatgatcaggatgggggccagctcgcagaccccgatcaggccgaccatcagcgggtcgttcgtcagcttcgccacctggtacgggatggtgacgtagctgatgaacgagccgaagctggtcaccgcgccgctgacgaagacgagccggaagtcccgggaggtgcgcagcggggtcaggtccacgctcagccggcgtttgcggtcggtcacaaccggccatcctgcccgccgcggctatttcatgaccagccgattagtggtggtgaaggtctccaggtcggccagcgcctcgtcgagcacgaacgatttggggccgggcagctcgtccagcgcgaaccatccggcgtccacgctctcgtcggtctgccgcagcagctcgccctcccagctgtgcaccacgaagctcatcagcacctgctggtaggtgtgcccgtagtcgttggtgtacgtgtacgccgtgtagaacgcgtacggcgtgagcgaggtggcccgcagcccggtctcctcccacagctcacgcaccgcgcagtcctccatgctctcgccgagctccatcgcgccggccggaatggcccagcggtggttgtccgagcgctggatcagcagcagccggccctgctcgtcgaagaccacggtgcgcgcgccgacgaagaagatcgtgtcggtgtcgccgatgctcgcgcgcaccttgcccagataggactctgcccacgtcaatcccactgagccaccccgcaggggaaaacccgaacgaaaaacatgggaggaagaatatctaggcggacttcttggcggctcttcccgaagccgccgattttcggggagccgccttcttggccggagccgccttcttggccggagccgccttcttggccggagccgccttcttccccggtttctcctcggcggcctcaccccgggccttcttggcccgctccaccgacgccttcagcgccgccatcaggtcgaccgccgccggcgccgcctcctcggcctcctccggctggaccacctcccggccctccaccttggcgtcgatcacctcctgaagcgctgcccggtagttgtcggtgaactcgtccggctggaagtcggcggccatcgagtcgatcagcgagctggccatcgccagctcggccggccgcgccttgacctcgtcgtcgaggaagccgaactccggcacccgcacctcgtccggccagagcatggtgttgagcaccagcacgccctcgcggacccgcagggtggcgagctgttcccgctgccggatcgcgatcttgacgatggccacccggtcggcatcccgcagcgcgtcgcgcagcagcacgtacggcttggccgcctgaccttcgggctcgaggtaatacgacttggcgaacaggatcgggtcgatctgctcggccggcacgaattccagcacgtcaatggcgcgggacgtgctcaacgggaggtccgcgaagtcctcatccgtcaagatcaccatttctccgccgccgatgtcgtaccccttggcgatgtcgtcgtaactgaccgcctcgccgtccacggaacacgtccgctgatacttgatccgtcccccgtcggtgcggtgtacctggtggaagcggatgtccttctcctcggtcgccgagtacagcttgacggcgatcgacaccagaccgaacgagaccgcacctttccagatcgcgcgcatgaggaatctcccaacggtgtcacggcacctgatcagaatggcatcagtgagacgcctgcgtaaggtgaacgcttttgcctatggtgatcgggtgccggaatctccgctgtccccgatgctcgccacggcgggcgacctgcccgtgggcacggagtggagctacgagttcaagtgggacggggtgcgcgttctcgcactgttcagcggcggcccgccggagctgtacgcccggtccggggcggtggtgaccgcggcgtacccggagatcgccgatctgcacctgcccgagggcaccctgctggacggggagatggtctgtttcgacgcggccggccgcccgtcgttcaccgcgctggccgagcggatgcacgtccgggaccggcagcgcgccgcccgcctcgcggtcaccctgccggccacctacctgatcttcgacctgctctacctggacggcatggactacaccggcctgccctacctggcccgccgggagcgtctggaggagctggatctggccgggcagcgctggatggtgccgccgtcgttcggcgacggcgcggccaccgcggcggccgcccgggagaaccagctggagggggtgatggccaagcgttccgactcggtgtacctgcccggccagcgatccgcggactgggtcaaggtgaagttcgaccgcaccggcgactatgtgatcggcggctggcgcccgggcgcgcgcaagctcggcggcctgctgatcggcgtgccgactccggcgggcctggcgttccggggccgggtcggcggcggtatcggcgccgtcgccgagcgggatctgctcgaccggctggcgccgctcgccgcaccggattcgccgttcgctcccggcgcggtgccgcgcgcggatgccaaaggcgcccactgggtacgcccggagctggtcgccgagatcaagtacggcaaccagacccccgaccgccggctgcggttcccccgcttcctgcggttgcgctcggacaagtcgcccgcggagtgcaccgacgatgcctgaccggatcccgatccgcctggacggccatgacctggagctgtccaacctcgacaaggtgctgttcccggcgaccggcgtgaccaaggccgaggtgatcgactactacacccggatcgccccggttctgctgccgcatctgcgcgaccgcccggtcacccggatccgctatccgaacggtgtcgagggcgcgcacttcttcgagaagaacaagccggccggcaccccggactgggtgcgcctggtgacgctgcccgtcccggggtccaccaagagccgggagaccgtcgagttcgtggtcgtcgacgaactggccaccctggtctggctggccaatctggccgcgatcgagctgcacaccccgcagtggcgggtcggtgcccacccggacatgctggtcgtcgatctggacccgggggcgccggccgggctgcgcgagtgttccgcggtggcggtgctgatgcgcgaccggctggccgaggacgggatcgccgcgttcccgaagacgtccggcaagaaggggatgcagctgtgctgcccgatctcgggtgcccaggacgccggggtggtctccgggtacgccaaacgggtggccgaggagctggcgcggctggtgccggggtcgatcaccgcgaagatggccaagcagctgcggccgggaaagatcttcatcgactggagccagaacaacgcggccaagaccacggtcaccccgtactccctgcgggccggcccggcgccgaccgcgtcgacgccgctgacctggccggaaaccgaggcgatggccatcggggacgcggaggcccgccagttcaccgcggcggaggcgctggaccgcgcacaaacccacggtgacctgctgaccggcctgctcgagtcgggtcccgccgtgccggtttgaaatggtctgcagtagtgtggactcttcgtcccactcgccggaaatcgaactgctggcaggcagcctgcatcatggcactctgtctgctggcgaacagccggatggcgtgcttgactggatttccggagctacgcgggcggatgcgtagcggggagcagttcggcacccggcggcaaccgggtgccggttccttttccgggccatttgtccggcacgtccgcactgcacgtgcggttgtcactaccgtgcgcttgcggccgctgttctgataggacagtaatagggggacgacccttggcgggcgcccgttcgccgagaaccgacgaccagacatgaaggacctatgcccgagggcgattcacccaccgtcgcacgccggcgcgtccggctcgcgctgcgcgaggcgcgggaaaaggccgatctgacccagctccaggtcgccgacgagatggaatggtcgctcagcaaggtgatccggatcgagaacggtgacgtctcgatctcccccaacgatctgcgcccgctgctcgccttcctcggcatccgggacaggccgacggtcgccgcgctgatcggcgatgcccggatcgcccgcacccggcagcggcaggcctggttccaactgcccgagttccgggagaatctgaccgacgccacccgcaaactcatcgaatacgagcacgaggccgcccagatgcggtcctattcggtctattacattcccggtccgctgcagaccccggattacgcgagagcgttgatgacccggttcgaggacgagctcagtgatgctcagatgagccgccggatcgaggcgcgcaaactgcgccgggaatcgctgctcacccgcgcccagtccggccaggtgcggatcgcggtgatgctcgacgagtcggtgctgcggcgcaccatcggcggcgccacggtcttcgccgcccagttgcgcgagctgcgccggctgatcgacgccgggacgatcaccatgcggatggtgccgttctcgctggacgccgcggtcaccaacaacgccagcttcgacctgctggtgctgggtgagggcgaggtgctctaccgggagaccgggctgagcgacgagatgatcgaggatcgggacgtgacggcgaaacaccgcgcccgctggaacaaggtgtgggacgaggtggccgacgaggccgccacgctcgccttcatcgatcgacagatcaagatcctggagaacccgatcgaggcgtacggtcgtcagcccccgttgccggactgatcacaacggggggcgccggctcccggctcagaagtcgcgggcgccggccgccgcgcgggcgaacgccggggtccgcccgttggcgagctcgctggtgaaccaggcgccgaaaccggccagcccgagcgcgagcagctcgatcatgaacagtccgccgccggccacccgctccggagcgcggacgcggaccatcagcacgaccgcgaagaccaccagcaccccgatgttgatcagggtgcgcagcgcgcccagccggcgcgcctgcgggcggcgcaggaacatcacgtcgatcgccccggccagcgcggccagtacgccgacgaccagtccggcggcgacgttccagtacgccagtgcgccaaggatgttaggccccccgagcaaatcggcgagatcgaacaaaacggccatggcgaacaggcccagtgggaacatcaccaggacgggctgtaccgcctgcccggcgatcctcaatcggctctccatccggtttcgccctcctttacctgcgcaaatacaggctcgtcgcggcatcctcggttggcctacccggtggtgggagcgatgaaacgccgtcacgcgtgccggaaaccacacgccgggtccgtcgcggggttctccgtaatctgcaacatggcattctgaccggtggcggtgcgatacgtggcgtgcttcactgagcgtagagcaacaagggcggagtcagagggagagacacaacaacggcacccggcggcaaacgggtgccgttgtccacctctccctcgcttcgtacttgcgcgacgttcccatcgcgaccgttccgattgctgcacaggcgaggcgggtctggtccctgaaagcccatcgtggccccggccttctccacctcgcaaggttccgcgagaaggagtgcgccatgagcacacgcacctactacagtgggtcggacgccgaagtcaccgacgctctcttcacctggcacaccgcgccggagtcattgatcttcgccattgcggatctgcggcatgtcgggttggtccagtcgcccgcgcgcacccgtccgtacgctccgcatctcgccgccggcgccctgctggccgtcgccgccgggtggaccctgctcgccgacccgacactctacgtaatcggcttcctcgcgatcatcggcccggtcctcgccttctcctggcgggagcgtcgccgatgggagctccacgcgcagtatcacggcagcgccgtggtcctttactcctccggcgacgtgcgggtgttcaatcaggtcggccgggccctgcgccgagccatggaagatggtcgccgcaccccctggggctacggcctggctgccgcctgaccagctttttcctaacgggtgacccggcgatctgaaccaaaaccccacctggcacgtctcgttctgataggacagtactaggatgtccgcgacctcgctgattgccactaatcagtcagcgaggtagcaacttggcgagggcagacgccagggcaccaaacaggctcagttcgactacttcaacgatgaaggtctcatggctgagggtgactcacccactgtcgcgcgccggcgcgtacggctcgccatccgcgaagcgcgggagcgagccgacctcacccagttgcatgtggctgaggcgatggagtggtcactcagtaaggtaatccggatcgagaacggtgacgtctcgatctccccgaacgatctccgcccgctgctgagcctgctcggcatccgggatcgggccgaggtgaccgcgttgctcgcggacacccggatcgcgcgagccaagcagcgcgcggcgtggtatcagacccccgatttccgggacggcctcaccgacgcgacccgcaagctcgtggagtacgagaacgagtccaccgagatccgttcgtactccatctattacgtgcccgggcatctgcagacgcccggttacgccagcgccctgatgacccgcttcgaggacgagttgagcgccgagcagatcggccgccgcatcgaggcgcgccggctgcggcgggactcactgcttccccgggcggcgtccgggcagctggagatcctggtgatggtggacgagtcggtgctgcggcgcaccatcggcggcccggtcgtcttcgccgagcaactcggtgagctggccggtctcgccaccaacggcgcgatccggatgcggatggtgccgttccggctggacgccgcggtcaccaacaacgccagtttcgaccttctcgccttcggcgagggggaggtgctgtaccgggaaaccggtctcggtgacgagatgatcgaggatcgcgaggccaccgcgaaacatcgcgcacgcttcgacaaggtgtggcacgaggccgctgacgaagacgacacgatcaccttcatccggcaacagataactgccctggaaaatcgcgaccacaaccgcggcgcccgggcgcacacataaccacaacccgatggccgcgtccggcatcgggcgcgggacgaattcctgttggagagttcccgagatggaaaacatgaacgcgcccgcatggcgtaagagcagccgctgcggcacgtcgacctgcgtcgaggtcgccaaggtcgacgacaactacatgatccgcgattcgaagaatcccgacgccgccgccctgaccttcacgaaggccgaatgggacgcgttcgtcgagggcgtcaacgcgggcgagttccatttctgaaggcttgcgagcggcccgctccggcatcggggcgggccgccccaaaatactcgcaaaaaacatatttccgccgttaccagcgccgcataactcacaattcgtgagataagcggcgtctttgtgttttcactcatgtcggtgaccgtccatctccgccgccatcacttaccgtgggattcgaaccaccacggaggtgcacagaaatgatcaaaacgaccagggagccgcgctggcggcggagcaaacgctgcgcccacggatcgtgcgtcgaggtcgcgagagtgggcgagctggtcctcatccgggactcgaaggatcccggcggcgcaccactggccttcgaccggcaggcctgggacgccttcctcgccggagtcaaggacgacgaattcggcagagcgtgaaaccccgcccaccggagttgctgggagccgcgggccgagcgcggcatactgcactggtggagggcaaccagcgcgccaccgatccggaccgcttcaccgatctccacgaggcggccgagaccctgctggacgagctcaccgagcgctatcaggtggagcgccgggagacgaaggagccgctcgggctcgacgaggcgctcgcgcggaccgtccggctcatcccccgcaccccgtccgccgcgccgctggccatccagttcaccggcgccggcctgcacctgcgcttcggccggtggtggcgggagtcgctaccgatctgcgactgtgacacctgcgccgaccggcccgggccgctcaccgaccagctgcgtcgccacgccgccgcgctggtcgagggcggcctctgggagcgggtccgccgcgggctgagcggctcctggttcgaggcccgcctgatcggcgccggcgtcaaggccgaccgcgagggcccgctctccgccgccggcgcccgcgaggcccgccgcgacgggttcgccgccgccgtccagtgggggccctggcaggtccgttcctgaactatccaccgaccggctgcggccggggtgggcggctgccgagcaggcgcagggcggtcttcacggtggggcggccgagggcgccggccatcgagaagtcgccgcggcagaaaccgctgaaggcgcgccagccgaggccggtggacatcgccgtgtgcacgatcgacgggtgccggctgaagacgccgagcaggcgacgcccggccacgatctccggctggagctcggcggcgatgatccggtcgtacgcggcgagatcgcgacttccggcggcgatctcgccggcccagatcccggaccggatggcgtagctgatcccctcccgggtccacggttcgagcagcccggcggcgtccccggcgaccagcacccgcccgcggcgcaccggcgagctcaccgcccggcagcgggtcagatgcccggagtcgcgcagcaccgggcgacccgacaggccgacctgctcgacgaactcccgcaggtagcgcttggtgtccgcgccgcggcccttctccatgatcacaccgacggtgagctcgtcgcccttcgggaagacccagccgtacgacccgggcagcggaccccagtcgagcagcacccggccgcgccagcgctcctgatcctgcggcgtggccgcgagttccacctcgagaccgaggtcctgctgctccagcagcacgccgacgtgccggccggtgatcccggccgaaccgtccgcccccacggccacccgcgcggtgagcgtttcgccgccggccagggtcacgatgacgccgtcgtcgtgctgatccagcgtacggacgatcgtgtggggaaagatttctgcgccggcctgctcggcggcccgacaccacgcctggtcgaactcgtcgcggcggaccagggagatcagcggctcggccgagacgcgggtgaactcacggcgcccggccagcgtgaacgtgatgctggagatcgtgtcccggaccggcaccgaggccaggcgtgccgcgctcagccgcagcgaactgccgagcaggccgccgccgcaggtcttgtaccgcggatgctcggcgcgttccagcaccgccacccgtgcacctcgcgacgcggcggcatgcgcggccgccagcccggcggggcccgccccgatgaccgcgacgtcccactccggttcccccagcacggacagaagtctagacacgtgaccggtagcctcctgtcggtgatcaccagcaccggcagcgcgctccgcggcaccacgagaagcgtctatatcgcgttcatcgccctgggtttcgtggtggcgacgttcgccgcccggatcccgcagatccgggactcgctgcggctcagcccgtccgggctcggtctggtgctgctggccaccgcggtcggttcgatcacctcgctgccgctggccgggcacctggtcggccggttcggttcgcgccggacggtgaccgtgatggcggtgacgctgggcctggcgatgagcgtggtcggcgtcggctaccggttcggcgtgcttccggtcgtcatcgggctctacgtctacgggttcgccaccggtgcctgggatgtggcgatgaacgtgcaggccgcggtcgtcgagcgccgcctgggccgggcgatcatgccgcgtttccacgccggctacagcgtcggcacggtggccggcgcgatcgccggcgccggcgcggtggcggccgggatctcggtgaccgtgcacatggtggttctgatcatgattgccacactgacggtggccgtcgccgtgcgccggttcggcccggacacgtcctcgccggaggccgcggagaccgccgggttccgcgagtcgctggccttctggcgggagccgcgcaccctgctgatcggcgtcgtcgtgctggcgttcgcgttcaccgagggcgccggcatcgactggatcaacgtcgcgatgatcgacgactacggcacctcggccgagatcggcacgctcaccttcgcggtcttcctcgccgcgatgaccgttgcccggtggtacgggccggggctgctcgaccggtacggccgggtcccggtcctgcgcgtcctggccgtgatcggcctgggcgggctgctgctgttcgcgttcggcccgcacccggcgttcgccttcgccggcgccctgctctggggtgtcggcgcgtccctcggcttcccggtcgggatgagcgcggccgccgacgacccggcgaaggccgcgccgcgggtcggggtggtcgcctcgatcggctacgtcgcctttctcggcggaccgccgctgatcggcttcctcggcgaccacctgaccgtggtgcacggcctgctggccgtggcggcgctgctcggggtggcgttcgcggtgtcccgggccctgcggccgatcggctgaggaacacgccgatcggccgccggggtcgactcagtcgaccggctgcccgtgctgcatccgggtgagaatccgggtcagctccggccccagctcgccgaccaggtcatgtccggggtcgccgcggttcggcaggttccacaggaagtggaagccgaccgccttcctctcgtcctggctgccggaccggacggcactttccatgaagtcgagggtgctgcgccaatccggctcgtcctggtcacccaggtaggaccggaccgtcgcctggaccacctcccagaagaacaaacccggcgagaaccgatcataggcttcaatgttgttggaatacacgtagtcgaagtccgggagagcggccaacagcgcgtcggcaaccctttccacagccggccggccatccatcagcaccccagcaacgccttgtaatcactgaagtcgacgtagctgttggccagcgagtcgttgacggccttgagaaggtccgtggcgaccgcgatgtccttcgacgtacgggtggtgaagtcgatccacactttcttctcgccctttttcggcttcttccagtatccctccgtgttgaggaacttggtgagtccgttctgcacgtcccggatcttcgtcaaatgctcgctgccgttggtcgcttcgcccgtcttccactcgttcatgagcgccgccatggtcgtgccgtcaccgtagatggtgatgttcagctcgggcgccagatcgagcgacttgtacagataacggaccatggtcttaaggtaatcgtggtccacatcgggcttcggcgcacgtgccgtctgttcgttgtgaaccaggaccgccgagcgacccgccaccaccatgaacgagtggatggcggcgaccgtcaggtcgtacatcggttgactgccgccgaaggtctggacgtcgacgaccgtcacccgctgggcgtccgccgaggcgagcagcgtgccggacgccaaccgcgcagcctcgacccagcgcaggttcgactgatcccagaacacgtgacccggcgtggtgtggatgacgctgatccgaccggcccggtcccgcaccttcacgtcggccagcgtggtgtcgatgtcgcggtgcagtgccgtgaccggttcggcccggcggacgtacgtgatcggatcgacggcgaggacccggtcgccgaccgcgatgtccgcgatccgcctggtggagccgtccgcgagcacgacccgggtgtcggcggtgaagctgtgcggggtgaagcaccgctcgacgaggtccttcagaccctgcaggacgggtgtgctgcccagcttccgcagggtgtcctcgatcgcgtccatgcccttggtgaccgcggccttggacagcgcggccagctcctccggagagaaggtgagcttggcgccgatcttcccggacagttcgagcagacgggcgacgtcgaccgtgccgagcgccttgatcgcgttgctcaggttgtcgaccgtgaacttggcggcgccggcgagcagatccttggcggacatcttggcgatgtccttgatcgccgctttcgcggtctggatcgcgccggactcacccagcttcgcgaagatgccgaggccgtcggtgccgccgatggtgacaacgtcgaagatgacctcaccgagggtgtactgccagcccttctccttccaatcgctccagtgcagcagttcccaggggtggaggatgagatccttgatccccttgaccagggcgttgcaggccttgtccgatttcggcaggtagctgacgtccgggacgctccactcgtcaccggccgcgttgtcgctgcccaggaacgtgccaccgacgcaactactggtcaccagcaggcccttggccatcccggccgcgctgtcggtgatgcccttgccgatctgggaaccaccgaagacgtggtcgttgagccaattggccttgtcgtcgatccagtcgttgaccttggcctcggcggccgcctgctccgcgttgtacttcgcccaggcggcgttcttcagatccttggcgatccccgacatcgcctgcgcgatgccccagatgctgttcgacaggttggtgatgttcgtgctgacgtccgagatcttcccggacaacacgttcgcgttggtcgccgcctgctgcgccttgctcgcgtaaccgctggcgttgttcgccgcctgctgcgccgtccccgagtcgctgccggcctgcgccgccgcgatcgcggcgtcctgggccgaattacccgcgtccctggccgcctccgctgcgtccttggccgcgtcgacggcgccctgtgcctccttggctgcgctcttcgcggcctggatcgcggtgttggcggcctggaccgcgcggttggccgcctcggccgccttctgcgccgccacatacgccggcttgacctgtgccacggccaggtccgccatctgctgcgcgtgcgcggccgccgcggcggcgtcgtcggcgtgctgctgcgcggcggtggcctgcgagtcggcgatctgcagcgcattgttcgcgatgtcgaccgccatcgcggcgtcgctgtcggtcgccgcgtagcccgaagccacatcgatcgccgaagcggccgggtcggcgatcccggccgcggtgatccgcgcatcgatcgccgcccggccggagatccgcgaccagaacgacgcgaccgccgactgccggaccgcgtcctgcgccgcctgcgcggtcatgtccgcgtcggcgcgcgcggcggtcgccttgttgatcgaggtgcgggcggcctgcaccgccgcgcgggcgtcggcgttggccgcgttcgcgtccttgatcgccttgaccgccgcggtcttggcgtccgcggcgtcctgccgggccagcgcggcctggtgctcggcggcacgcgcatccgcggccgcggctagctagctagcggccgcggcagcggcagccgcggcggcctggcgggcgtcagcggcagcggccgaggacgcgtccgacgccgcgttcgcgtccctcttcgactggtcggaggcgttcttggcggcgttggcgatcgccctcagggacgcggcgtcattgcgcagccgctgcatctccgcggtgcccgggcaaccgttcccggacgggttgtccggatacttgcaggccatctccgcggacagcaggtgtgcctcggcggcctgcgccgcgaactccttggagctggtgttctgatcgtcggccttggccttctcgatcagcgtcttggcccgctgcgccttgccggcgaacgcggcgcccgcggccagcgcgtcctcctgcttggtcttggcctcaccggccttgccgatcacgatgttctgctgatcgatcgcccggccggccgcctggtacgcggtgatcgactggctgatcgccgcactcgccgccgcccgcgccttggcctgctgctgcttggcggcctggtagtcggcggcggcgttgtcggcgtgcccctgcgcgctgtccgcgtcgttctcggcccggacccgctggttgtgcgcgtcggtggcggcggcctgcgcggccgcggccagcttctccgcccggtcggccagcttctccgccgacgcctgctcccgctccgcggcctgccgatacttgaccgcgttgttggcatccacggtcgcggcgtgatccgcgtccagcgtgcgactcgcgccctcggtcgcggtcgccgcctggcaggcggtcatcgcggcccccgcggccgaggtgcccgcatcggcctgcgcctggatcacgtcggcccacgcgatgttgtgcgacagaccggtcttgtccagtgtctgcgccgcggtcgccgcgaccccggactgcccggtcacctggtcggcgtatccctgggcggtgacggcgtcctgacacgcctgcatccgcaggttcatcacgtccgtggtgtgcgtcgccttgccggcgttgcgcagcgggatgtccgcggcgtagatcgagtcggcctgcttggcctccttgttcgccagacccatcgcgttcgacgccgaggtcaatgcctgcgtcgcggcgacactcgcctggatgatcttcttctgcgcgtccgcggcctgggcggcccgctgggccagatcggtcaggtcggcgaccgccttggaccgggccgcgagcgcgtcggtgatctgctgctgcgcgtccgcgtcctgcttgctggccgccgcgtacccggtgttgtagaactcggcgatgaccaccgggtcctcactgtccagcgcggcctggccgagcttctgcacctcgtagccaccgttggcgaccatttgctcgacccggccctggatcagcttggcctgctgcgccgcgttcagcgcatcctgcttgtccgccagatcggcggcgtcatgcccggtcgccacgaacgcggcgatcttcgcgttgtcgttggagtccagagcggcctgcgcccgctgccgcacggtcgggctgccggagacggcccactcctggacctggacccggttgtggtccgcctggtccttctggcgctgctgatcggccttgcggtagaccggcagcccgttgtccagaaagtccttgatctgcgccggatcgttggtggccagcaccgccgtggcagcggcccgcaccgccggatccgcgtcgtagtcggccagatcctgggtcagcatccgatccaggtcggcgtcgtcgatcggtgtgtcggccggcgccttggtgtccgcgccgaggagttgctgcagcgcctcctggacggtcagcgcgtgcggctgcaccaccggcgcctgcacccgcggcgccgccaccgcggcgccacccggcaccgccacggcgacggccaagccggccgccagacctacgatccaccgcaggcggcgtcgttgcatggaagatttcacgagactcatttcccgatcgagccgaagagcaggacaaagagcgccgcccgtcggcgacgcgacgatggtgggatggcgccggctaccggccgttcacgccatggggacgggcgatcggcgaaagcgcacgacgaagcgtccagaaagccacgatggaacccccgtaccatcatcacgacgacctgaccggccgccgcatatcggttgacccgccgtccgctgagggatggcggtgagatcaatcgatgcagtcttacagcaagccgccggtcgccgacacctcggataggcgcttaccggtcatttgccgggaaggtcgagtatgtccctatgccatagatcaccgtaactgccgacgaacccgagagaagttcttcaggttgcggcccggttgccgatggtcaccggcgggaaggcccgaccggccttcgcgacgaggaggaaatgtggttggggcattgaggtcgctgcgacgtggtctggcgatcgggccggtggttctcgccgccggagccggctgcctgaccggtgccgcaccggccgcggcggcgacaacccccgccgtcgccgcggagcaggtcatcgtctcgctccaggacgcctcgcgcgtcgccggcgtcgaagcactggtacggcgatccggcggaacggtgcaacgggaactgccgatcgtcgacgggttcaccgcgcaggtctcgccggcactggtgacgaccctgcgggcgacggccggcgtacggtcggtgaccgcgaacagcaccggccacctgaaggcggtcgatccggcgctcggctacgacgcgaccaaagacgagggatcgctgtccttcgtccggaacaccatgcacgtcaacgacgcctggaaggccggctacaccggcaagggcgtggacgtcgcgctgatcgactccggggtggccacggttcccggcctgacctccggcaacgtggtgaacggaccggacctgtcgttcgagtcgcagtacgccgatgtccgctaccgtgacaccttcgggcacggcacccacatggcctcgatcatcgccggccgggactcggccggcaccccggcccagtactcggcgagcaccgggttcaccggcatggcccccgacgcccggatcgtgagcctcaaggtcgccgcctcggacggctcggcggacgtgtcccaggtgatcgcggcgatcggctgggtcgcccagcacgctcacgacagcggcctgaacatccgggtcctcaacctctcctacgggaccgacagcacccagtcgtccgtgctggacccgctgtcgtacgcggtcgagcaggcgtggcggcgcggcatcgtggtggtggtgtcggccggcaacgacggaaccacccgggaggaactcgccgacccggcgtccaacccctatgtaatcgccgtcggtgccgaggacccgaagaacaccgccggcgccgccgacgatctgatcccggcgttcgcgcagcgcggtaccggcacccggcacgtcgacgtcgtcgcgcccggcgtccacatcctcggtctccgcgtgcccaacagctacgtcgaccagaacaaccccgcgggacgggtcggcacgcggttcatccgcggcagcggcacctcccaggccaccgccgtcgtctccggcgtcgcggccctgctcgcccagaaatacccggcggccacccccgaccagatcaagtggctgatcaccgcgaaggccaacccgttcccgctggccaagagcatctggcagggcaccggcctggtcgacgtgcacatgtccctcggtctcaacccggccagcgccccggtgcagaacttcaccgccacgaccgggctgggcaccctcgaaggcgcccgcggcagcggacacgtactgatcgacggcatcccgctcaccggcgagaaggacatcttcggccagtcctggaacgtcgccaggacagcctggtccggcggcaccttcaacggcaccacctggaccggcaccggatgggacccgtccaccgccggctggaccgcgccgtcctggaccggctccgactggaccgggcggagctgggccggccggagctgggccggacgcagctgggccgacaacggatgggacggccgcagctgggcgagcaactgctggtacggccggagctgggcctcggacggctgggccgacgcttcctggagctgatcggaccgggtcacgcccagaacagagaagaagaacgcgccggccaacaggactgttggccggcgcgtcatctgagccgcctgacggaatcgaaccgtcgacctacgcattacgagtgcgtcgctctagccgactgagctaaggcggcaacggttcccaagtgtacgacatcgccggctcggctcggcgggagggcgggaagtcggcgggcagccgatgtcgtaccccggggctaatgtgccttctgtgacggacgataagtcgatgcctgtcgttcccccgccggccggttggtccggggccgagcacaccgtgcccacccggccgaccagcatggatccgcaggagctgggcttcacgccgaagcagccgatcggctggctggcgccgctgctgctgctcagcaccggtctgcgcgcgctgctggcgatcctcttcggggcgtacatggacaagcgcgagctgcagaacgcgctggacgccgacttcttcgaccactccgccaccgctgacggcgagatctggctggattacgtcgccgacctcggtgacggcttcgacgcgacgtattcgatcgcctggttgctggcccagccgcggctgaccgtggacggggccgcgctgccccggggccggctgctgctgatgggcggcgaccaggtctatccgctggccagcggcgacggctacgagagccggatgaaggggccctatcgggcggcgctgccggaggcgccggccggcgagccgcggcccacgctgttcgccctgcccggcaaccacgactggtatgacgggctgaccgcgttcctgcgcctgttcgcccgccgcaaagacggattcatcggcggctggcgcaccgagcagcgccggtcctatttcgcggtcaagctgccgaacaactggtggttgttcgcggtcgacgagcagttcggggcgtacatcgacgatccacagctgctctatttcgagaaggccgcccgtgaggtcaccccggatgaccggatcatcctgatgaccccgtctcccacctgggtgaaagcgagaaacgacccggaggcgtacgacgcggtcgactacttcctgcggaccattctcgcgccgacccgggcgcaggtccgggtgctggtctccggcgatctgcaccactacgcgcggtacaccggcgagcaacgcgagctgatcacctgcggtggtggcggagcctatctgctgggcacccacaacctgccggagcaattggtcgtgccgccgcgcgagacgctgacccgcagccgcagcctcagccgggtctacgacctcgcggcccgcttcccggccccggcggcctcccgccggctgggctggggcgctttccgccgggtgccgcggcgcaacgccggcttcgccaccatgctgggcatcatccacacgctgaccatgctggcgatggccggcgcggccagccagggcggcatcatccagcggctgttcagcatcccgctgctgctcatgctggtgctgatcatgctgggcacggtgttgttcgcgaaaccgccgggcgccgcgtcggcgaaacacgcccgccactggatcctcggcgtgctgcacggcctggcccagatcggcctggccgccgccggtgcctgggtctggctgcggctgcccttccaggagtgggcgtggcccggcccgttcgcggtggcggcggtcctctacggtccggtgatcggcctggtggccacccaggtgctcgcgctctacctggtgattgccagcatgttcgacgtcaatttcaacgagttgtacgcgggccagggcatcgaggacgcgaagagtttcctgcggctgcacatcgacgcggccggcacgctgaccatccacccgctgggcgtcgaccggatctgccaccggtggtccgccgacccggacggcgagccgcacgcgccgtggctgcgccccgagcagccgctcgacgtccagcacatcgagccgccgatcatcatcagctgaggcccgtctccggggaaaggggaggtgttgcggaacaggccgcgccgaggcagcggacaccgccgccgacgaccgtcaccggcggtcgtcgccgtccgcgggccgcctgccgcccggcttcgggtcggcctgtgcgcgggagtcgcgttccagatctccggtcagggcgcccgaccgggtgagcgcgtccagtcgtacgcccaattccttgatgtccatcttctcgcctcgcaccagggcgtcgcggacgaactcccggtaggccgagctccgcagcacttcgcgcggctcgatcgcgccggtgaagagctgctcgccgacctcgcgggtcatcgcgtcctcgctctgcgccagggcttcgaagacgagccgccggcggcgcaggtcatcgccgagcacgacgccgtacgggctggcgtcgaacgccgccagcagctcgcggggatctgccgcgtcatcgtcgggcatgtcgctcccctagcgcatcggaaggtcgggcacggtggccgtcggcggaagatcggcgatcgggcccagactcccgatgaagccgagatctccggccgccgaggcgaccgcgctgctggccgcatccgcgcgccccatgagatccatgatctccttggtgatgtcccacatcctgtaggcctcgtagagggacgcaccgcccaggaccagggggccgataccggcctccggggtccctccggcgccggtcatcgcggccgcgaaaaccatcgcggcatcgctgaggtccatgatcagggaccctactaccttgccgatctcgaacatcgcttccgcggaggtctgatatcggtccgcggtctcctgcaacaaaggcgtccattcgatcatcttcttgccgttggtccagcaattgacgatcaatgcgtcggccccgttgccaccccataccgcgtcgacgccgagcgcgtgccatcgcgagttctcacccatgtcccggacggccagcgcgacattgttgaagacgtcggcgcattgacgcacgccagtccagtcaccggcgagtggcttcgtccactcctcgaagacgtcgtacggccggtcgaacacgccgatcttcgcggcaagccaggtcgctccccagatcgtgtcgcggatccccgaggtgggactcgcggcgtcccctacggccggcgcgtaccgatactcgtcggtgttgtcgtagtcgggcagcgcggtcagccgggcctgcggctcgaaccggtcggtgaaggcctgcgcgccgcccggggtgtcgtaggagtacgggccgagctcggtgcgatcgacggtggcgcccggccaggagtcgtcgagctttccggcgttctcccggtcggtgttgtcgtaccagttcaacgccgaggtgatcatggccgcgccgcagaaggcgacgtcgtattcgatccgatgcagataggtgtgcagatgatcgacgatcgcctggtgactgccccgagcctgagcaaggagcccatggccgtaattcaacgcggtgttggccttcacgtagtcctgggccgccttcgcgtcctgctccatccgccggaacgcggacggcaggccacgcgccgcggggatgtcgacccagaacctcacgcgtgcccccgatcactggttaccggcttcgctgatgggtatagcccatgaccaatgcgtatggcgtagatccggatcgtactgtcgcatatacgacccaaccgcggctcggatgcgtacagtaactttcgtgcggatgaccttcgaagtcggcgtgaccgaacggcacgttgtcgagttctatttcagcaagttctggggcggcgtcaagatcaccgtcgacggagtcgtcgccttgcgcaccgttcagcttctgtcgttcagcgtggtcaagaggtacaacctcacggtgggcaccagcgaacagcatgccgtcaccatcgagaaacgccgggctctgctcttctccgcattccggcaacagccggtccgcgcctacgtcgacgggacgttggtcgctgaaggcgccgcatgaccttctactgatttccgcccgactcataggcgcggcgtgaaccacagacgtcggcgaccgggcagcggcgcagctggccgtcctcgatcccgcggacggtgaccgactccgacggcgggtggcgggccacgacacgcccctcggcgccgtcggccgtcttcacccgttcgcccgggcgcggatacgtgtcgctgcttcccgaatacagcgggtgctcatatttcaggcagcacatcagacggccgcacgcgcccgagatgcgcagcggattcagcggcagatcctgatccttcgccatccggatggtgaccggctcgaagtcggtgaggaacgtggcgcagcacagatcccgcccgcacgaaccgatgccgccctgcacccgggccgaatcccgcgcggagagctggcgcagctccacccggcagtgcagggtggcacccaggtcacggaccagcgaccggaaatccacgcggtgcggggcggtgaaatagatcgtcgtccggtccccgttcgccccggccggatccaggacatgatcgacggcgaccaccttcatcggcagctcgtgcgccttgatcaactttttggcggcgaccttggcctccgccttgcgcttgcggagcagctcgtcgcggcgcagatcgtcgtccaccgccaggccgaggatcttgggaaaaccgtcggtctcctcgctgacccattgcggcggccagacgcactccgccacctcgggaccgtcatcggtcgggaccaagacccggtcgccgaccgacgggctgaactcacccgggtcgaggtagtagaggcggccataccggttgaagctgaccgcgcacagcatgcccatgggatcaaccctacgaccccgggaccggtgccgacgacactgcggctgccgcgtaccaaatgccggttttgaactacccgggcgggttgtcgcatagatgctgcgcaaccgccccaatcgaccctcgttggccagtcccgtagacgccgcaccgccagcaccatcccggcttcacccgcccgcctccgccctgccctgacaccgccccgccgccgccttgccctgccacgaggcttcgccccgtctcgtcccgccccgtctcgtcccgccccgtctcgtcccgccccgtctcgtcccgccttgcctgccccgccttgcctgcccccgcctcgaaaggacttgccatgacacccgccaggtcgctggccgccagcgtcgctgcgctcgggttcgcgagcacgctcaccgcgcccctgcccgcgcatgccgcatcgacactcgcccccgccccggcaccgtgccagcaagcccaccgctatgccgcccagtccgaggccgaactgctccgcatcgaacgactcgacctgcgccccacgccgaaccgggatcacggcgccggcctgccacgccacgacagcggcgaacgcccgtcgatcgcccccacggaaagcgccggcgaggtcctgcagcagctcacccccgacgatccggccgccaccgccggcagcggcagcccggacagccccgccgccggagaggacgcggacagcgcggacacatccgacgccacggccatgcccgcaccgggcgtcgtccccgcggcctaccaccccggccaccgcgcccggtccggccttgacgccgccggcaaccgcgacgtccgctggaagcgtgacgccgccggcaaccgcgacgtccgctggcagcgtgacgctgcctacaaccgcgaggtccgctggaggcttgacgccctcgacagcagccacgccgaccgcgacgcccgcatcgagctcggcaaacccggcgccacgggcggcggcgacgccaacggcgacacgaggccggcgaccgccggtgccggcgacacgacacaggtgatcggcggcgtcggggtcggcgacgcccgaagcgtcatgatcgccgacggtccggtgaagtccgccgccgctgcccagaccctggacggccgggtcgccggcgctcccgccgccgagcaggtgttgcagcagacgccgccgacccactccggaccggtcgagcagcacaccgccgccgaacgtctcggcccgatccagaccggcacgacgacgttgtccgcccacgcccgctggaccgacgcgatggcctgcgccgcaaccgccggcgaaacctcccgcgcggcgaccgccctcgaccgggtcacgctgaccggggccaccggcgagctgatccgcgtcccggcgaagtcctctaccatcagcaacaccgccctgaccggccacggcaccaccgcgaaggcggtcgcttcggcaaccgtcagggccgccgagttcaccctggccggcggcgagatccacgtccgggtcctccgcgccccctcgctgcaggtatccatgtcagccgccaccggcggcgaggtccgctatcaacccgcggccgtcgagatctccggcccgcatttcccgcgtacgcggttgagcacggccaccgaccacgcagacatcacggtcagcgacgcagcccggcccacggagtccgccaccgtcccggtcctcccgtcccggggtccggcactgccgtcgatcccgaatctccccgttccctcccccaccaccggccccggttccagtaccggaacctcggcccggtcctccgacaagacctccacccgagccggcaacggacctgacgccggcggaacggttgcccgcggcccggtgttggagagcgctccggccggacaagccctcgtccgtatctccctgggtgacgtccggcaggcatcgaagggccacgccttggccgcccgagccactgccatcaagatcgccgtcctgcgctcccaacactcctcgaaggaccgcggcaaccccggctacgaatcatccgcggtgatcgccaacctgggagtcggcatcctggaagccgccgccgtagcccccgaacaaggcaaacgcaccctggaatccggagtccagggcggcacccttccggtaaccggcccccgctcggccccactgttcatcaccggcgccggcctgctcatcggcggcctctgcgcctttctcctcggcacccgtcgccgccgcccgaccccgtaacacccaccaccgccacccacacccgggcacccgctgcaccacgaccccggggtcgtggtgcagcgccacaaccccggatcccaagctgcaccacgacaccgaatcccaagctgcaccacgacaccggatttcaagctgcaccacgacaccggatcccaagctgcaccacgacaccggatttcaagctgcaccacgacaccggatcccaagctgcaccacgacaccggatttcaagctgcgccacgaccccgggggtcgcaaccctgcgccgcgacccccgggtcgcgagccggtcaagacccgggtcgcaccggctttccggggtcggcgcggcgccagatctggcgcggggcgtagccgtcacggcgcagccagtgttcggtgtagacgatccggtccgggtcgaggacgacgagcgtctcagccggcggttcgctgaggagacgcccgcgttcggcgtgctcgttctcccagcggaaggcctcccagtagggcacctgcccggggtcgcccggcccgagcacccgggctcggccgaagagctgcgcccctcggctgctggccaagccgaccagcggcgcgaagatcccgaaggacacccttgggtcatcagcgatgttccgcatcttcggcgaccggggcgacgccgtgaacatcaccgccagatccaacgagtagtaccgcaccggcgtggccaccggcccctgcccaccggcagtggcgagcacacccatgttctgactggagaacaggttgcggatccgctcctcaagccggtccttcggcaaccgccggtccggcacgtccccggccagccacggattgttcaacggcatcgacgaaccatagcgacccttggactcccggcggcgacgggcaagcatctcagcgcggcgaatccgggagtgtcagcggcccctgagaccacatcgggacggcaaccatccgtcctgcaagacgaccccgggatggggcgccggcgtgcggacggacgacttcaggtcgactgtggagttgtcaaagatgaggagtcgtcgaggagattctcggcgcggtcgtagctgtcggcgatggtgcggagcacgtgggtggcaatggcagcggcggcgcgggtttccgcgggctgcgggaaaccgctgctcacggtgaccgtcaaagcctcggcggagttcaggctgtcggccagggcgtaggccagcgcggcgcgggtgtgcgtcatccagtcgtgcagggcgccggccaggtcggccgtggcggtcatccggcgggacaggctgtcggggccgacgttgagctgctcggcggtgcggcggcgggtggcctcgtaagcttcggcggcgtggcccgtccaggtggtggccagcggcagggcgtcagcggtgtccgcgcagacccgggcctgtgcgcggagctcggggacggcgtcggccagcgcggccggatgcagggcggcgaccgcgcggaccgcgtcgccgggtagcaaccggacccggcgcagctcgggccagacatcgtggccggccggcgcaccgaccgacgtgagcagttgatcgacccggctgagcagcggatccgcaacggtcagaagttgatcgagccggtccatcagaaacctcgccgcacagggtcgcgccaccccgtcgacgccaccgcggaggcccaccgagccgatcgccgcacacgtggcagcgaacgccggggaggcaaagcgcacgaaagcgggcgcgaacgaggcaaaaggcgcggaagcaaacacggaccaggcaagacgcccgggcgcggacgtgagccagacaggacgcccaggagcgggcgaggcaagacgcgcggaagcgagcgtgggccgcgcatcagagacctcgcagcaggcggtgacgaacggactcgtcagtctggctgtagtcccgggaggtgctgcggacggactgggccagatcggtcaggcgcccggacagaccggccgcctcgtcggcgcgggcctggagcaccgcggcccacctctcgtgcaggcggtggccgagccggccgggccggccgacatcgtcggcgccgaacgccccgggtccgggcagcaggtggggcgcccgtcggtcgatggtgctcagttcggcggccgcctggtcgatccggtcggcgatgcggtccatgtcagtggtcctccagggagcggaacgcgccgaagacctcggcgtgcagcttgtcacgagcccagcgggcggcctcggtggcgctggcgatgacggcccgcagctcacgggagaactcggcggcggtgcgcttgacgaactcgccctgcacccggacatccacgatctcgccggtcgcggtgaccaccacctcgatggtctggtcgggtgagtgcaccgagacctggtgcgtcgccacggccttgtcgaactcggcacgcaggccctcgacgcgccggtagcgatcgatcgcctcatcgatccacgtctcgtcgatctctcgggccatgcacctggctcctcaccgcgcgtcacgttgccgtcgcgttccggccatgaatctaccggcctttcgcagctcgcggagtcctctgtggataacttccggtgcggcacccggcgtcaccctgacaccggttgctgagcacggtgcgtcagtgctggccggacgcctggtggaggacccgggccgaggaccggccggcggaggtggggcggcacagacacccggcgacggcgtggtgtcacccggcggggacgaccggtccgaggaatgtcggagggtggccataccatcggcgggtgagttcgcatgacgtgttctccgacctggtgggccaggcggagccggtggagacgctgcgccgggcagccggggcggcggcccgggtggtcgccggggagcaggtggccagcggcgcgatgacgcacgcgtggatcttcaccgggccggcgggcgcggggcggtcggtggcggcgcgggcgttcgcggcggcgctgcagtgtgagcgcggcggcagcgggtgcggggagtgtcacgggtgccacaccgtgctgggtcggactcatgccgacgtgcggttcgtggcgccggaggggttgtcgatcggggtcaacgagatgcgcgccctggtgctgcgcgcggcgaccgcgccgtccggtggccgatggcaggtggtggtgatcgaggatgccgaccggctcaccgaggcggccggcaacgcgctgctgaaggcgatcgaggagccgccaccgcggacggtgttcctgctgtgcacgccgtcgacgcatccggacgacatctcggtgacgatccggtcccggtgccgactggtggcgctgcgccagccgccggccgacacggtggccgcggcgctggtcgagcgggacgggatggcaccggacacggcggcctgggcggccgcggcggcacagggggacatcgtccgggcgcggctgctggcggccgatccggaggcgcgggcccggcgggaggcggtgctggcggtgccgaaaaggctgaccggggtgggcgccgcgttcgagatcgcggcgggcctggtggccgcggccaaggcggaggccgccgggagtgtggccgagtccgacgcgagtgagcggtcggcgctggagcaggcgctcggcgcgggcggcaccggccgcggggcggcgggcgcgatgcggggcgcggccggtcagatcaaggacctggagaagaggcagaagtcgcgggccacccgggcgcagcgggacgcgctggaccgggcgctggtcgacctggccgggttctatcgggatgtgctggtcacggcgatgcgggcgccggttgcggtggtgcacggcgatgtcgcgcagcagtccggggcggccgcccggaagtggaccgcggagagcacgctgcggcggctggaggcggtcctggcctgtcgcgatgcgatcaacgcgaacgtgaagccggaaatcgccgtcgaggccatgatgctgaccctctggaaaggctgaccacgcgaaaggccggcagcgggcagcagcgggatgcggccggtaaaggcaggagcgggaaaaggaggctgcgccggcggacggggccggcgcagcctggcacagggatgaggggacggcagtcagcgccgagcgatcaggaacgtctcccgcagggtgcgataggccggcttcggctcgaaggtctcggtcatcggcgtcgccgacccctgaccgtcgaagacgcccggcacccaggagtacttgtcgctgaagccccacaccgtgtacgagatgcagtgttcggccagcaggcaggcccgcagcagcagcccgaagccctcgctctgccccgccacctccgcggtgtccgccggcagctgcatccgcacgtcgacctcagtgaacgcggttttcacgccgagccggtcgaagcgtcgtacgttgtccgccgcggtgatcggcaggtcgtactgcagggccagatgtccctggatgccgaagccctgcaccgggacgccctgcccgcgcagcttcttgatcagtgcgtagtaggcgtcgctcttggcgttgagcccttcgacgttgtagtcgttgaggaacaggattgctttcgggtcggcttgatgcgcccaccggaacgcgtcggcgatgtagtcgggtccgagtgcccgcagccacagggtgtcacggagggtgccgtcctcgttgaacacctcgttcgcgacgtcccaggcccagatcttgcctttgaagtgcccgacctcggcgaagatgtgctgccgcagcagcgtgcgcagctgcgcgggggtgtacgcactttcggtcagccaggacgggttctggttgtgccagacgagggtgtgcccgcggacgagctggccgtggtgacgggcgaagtcgacgagctggtcggcggccgcccagtcgtggacgccgggttgcggttcgacggcctcccacttcatcacgttctccggggtgaccgtgtcgaattcgcgcgcgaccgtcgcctggtagggcgcgtcggcggcgagcgccgtcatgtcgacggcggtgccgatgcgcactccggtgccccgggcagcggcccgcaacgagccggggtcaagggcggaaaggacggatcgggcggacgtggcggagggtcgcggggaggccaccgcccgcaggggtgcggagccggccaccaccaggcccaccgcgaggagcacggcgatacgagtggatctcatctgaagtgcctccgaaacttacggtgacatgccgaaacgttatgcacgatgcatgtcccgcgtcaacgatgtccattgatgaacatcggagcattcggatggcgcggcagccgatattccgcccttgacgccatagatcgacagctctaggttacagagacctgtcgcaacagtttccgaaactttcggacgacggtaaaaggcgacggtaaagaaacgatacgagacgcggcgactaagcggaggaggaggacgggctggcggcgggccggctcgcgagcagccccgacatccgatccaccaccatctccgccagatctccggccggccgcgccgcatccagcaccagataccgcttcgggtccgccgccgccaggtcgaggaacgcataccgcacccggtcgtggaacgcctgcgattcgctctccagccggtccacgcccgcaccccgcgcactggcccgcttcagcccgatcgccgggtccacgtcgagcagcaccaccaggtccggtttcagcccgccggtcgcccaggaggacagccaggagatctcctgcaccggcagcgtccgcccggccccctgataggccagtgacgagtccacgtaccggtcgctgatcaccacggcgccccgggccagcgccggccgcaccacggtcgccacatgatgggcccggtccgccgcgtagagcagcgcttcggcccgcggcgacggcccgtcctcggagtggtcgagcaccagcccgcggatccggccgccgaggtcggtggctcccggttcccgggtcaccaccacgtcgcgcccttcggcgcgcagcacgtcggccagccggtccacctgggtggatttcccggccccctcgccgccctcgaagaccacgaacagcccgctgcgcaggaactcctcggccggcgtgagcggccggccgcggaccgacccgatcaggtcggccaggatcggcacgcccttcttgtcgtccatctgccggaacgacccgatcccgacccagatcccgatcgcgccggcgaccagcagcagcacccgggtggacgagatgtcgaagtgcaccgggcccaggttgacccggcgggagctgcccaggccgacgagcaggccggccagggtgatggcgagcagcagcaccatccggacgccgatctgcacgacggcgaagacccggccgcggaccgtgtcgtcgacctcgccgtagagcagcgtggtgcccgccaggaacgccatgccggcgccggcgccgacgagcagcgcaccgaccagggccatggacaggtggaaggccaggccgaggaacatcaccgagccgctggccaggacgatgttcatgccgaaccagcggcgccgggagagctccttgacgatcatcggaccgagcccgataccgaccgccaggcccaggaagatggtgccgaagagcaggtagaaggcggcttcgccggcgcccagcgaggtggcgtaggtgcgggccgcgccgatcaccacgccgccggccgcaaacgcgccgaagatgcccagtaccaggccgcggaccagcggggtgcgaccgatgtatttccagccgtccaggaactggtggaacatgctctgctcggcggcctgctggcgttcggcgctcttgccgccgatctcccggatgccgaagaacacggtgagcgcggtggccagccgggacagcgcgttcatgtacagcgcgagctggaccggctgcgcccaggcgggcagcgagacgccggagtgctgcaccccggcggtcaacgcggacagggtcagggcgcccaggatcggcgtgatgccgtacgtcgtgaccagggtcagctggttcgacacctcgatctgggacttgtggtggagcaggttggggaccgccgcctccttggccgggatccagatcagggtgatcgtctcgccgatgaaggtggcgatggtggcccacgtgacggtcagcgcgggtgagccgccgagcagcggcaccagcgggatcgacccgtagaacacgaaccggatcaggtcggtgatcaccatcgtgtagcgccggtcgaaccggtcggcgaacaccccggcgatcgggccgagcagcagcgccggcagcaggcggacggcgatcgtgccgccgaacgccgcgccctgcgccgccgagttgctgaactgggcggaggcgaacaggccggtggcgagcaggccgatccagtcgccgaacgaggcggcgccgagcaccagccagaggcggcggaacggccggatccggaggacggagcgcagcgcggccgcacccgtgaggtcgaccggtgcggtctcctggcggctttccgtgttgatggcccctacctccccgtggtcactgctcggggagcactgtatccgcccgccctggtcatcgggggttcccaccatcgggtaagccagagatgaatgtctttcgcgttggtcgggatcgagatagcgtgccggtgtgctcactgaccgcgatgccctgcgccagcgcctggagcgcgccaccgaccacctggagaccccggtcgccgcggtggacctggctgccttcgacgacaacgcggaccggctgaccgcccgggcggcgggcaagccgatccgggtggcgagcaagtcggtgcgctgccgggcgctgctggagcgggtgctggcccgccccggctggcacggtgtgatggcttacacactgccggaggcgatctggctggtccggtccggagtgaccgacgacgtgctggtcgcctacccgaccgcgcaccgggccgcgctgcgcgagctggccggcgacgaaagcctggccgccgccatctcgatcatggtggatcacccggcccagctggacctcgtcgaccaggtgaccggtcccggcgaccgcgccaccgtccggctctgcatggatctggacgcctcctggaaaccggccgcggcgctgcacgtcggcgtccgccgttccccggtgcactccgcggtccaggccggcgagctggcccgcacgatcgccgcccggcccgggttccggctggtcgggctgatgtcctacgaggcgcacatcgccggggtcggtgacgatccgccggggcaggcgctccgcgcccgcgccatccggctgatgcagagccgggccttccccgagctgctgcggcgccgggccgcggcggtgcgggccgtccgggaacatgccgatctgcggtacgtcaacggcggcgggaccggcagtgtcgcagcgaccagcgccgacccgtcggtcaccgaggtcaccgccggttcggggctgtacggcccgaccctgttcgacgcctatcgcaactggcggcccaccccggcggcgttcttcgccctgtcggtggtgcgccgtccagctccgcggatcgccaccgtgctgggcggtggctggatcgcctccggcccggccgaaacctcccggctgccccagccgtacctgccggccggcctggcgttcaaggccgacgagggtccgggcgaggtgcagaccccgctgctcggcgaggccgccgaggttctgcgcccgggcgaccgggtgtggttccggcacgccaaggccggcgagatgtgcgagcacgtcaacgaggtgcacctgatcgacggcgaccgcagcacgccggccccgacgtaccggggcgagggtcatgctttcctgggctgactcaggcctgcacgtgccggtgcaggtactcccggatcagtgccttcacctcggtgagcaccgcctcgtcgccggacgggtcgcgccggaaggccagcttgatcagcgcgtcggccgcctccaccgagatctgcagcgcgaaccgcacccggttccggtcgaccaggcggaactggtcggtcagcagctcggccaggcgctcggcgatcaccgcgttgttgtcccggtcggagtcgagcaggtgcaggtcgacgacgtcgccgaagtgcagcgtgcggaaaccgggaacgctacggtgcatgtggatgtaaccgtctatggccgcgtccaccgcgtcccaccagtgggcgaacgtctccgacgcgaaccggtcggagaggctctgcagatacgcgtccatgttgcgcagtgccagggcctgcacgatggcccgcttgtccgggaagaactggtagaccgagccgatggcgacctcggcccgctcggccagcagcgtcgtggtcaggccctcatagcccacctcgtccaccagctcggcgcaggcatcgagcatgcgttgaactcgggcaacgcttctgccctgcaccggaacccgccgcagcggtccggtgctgacggttggtgtcgacacgcgtcgccactccctctcagcagtgagattcgttcacgacgacggaattcatacctggtcatgaataaatctcagtgataaatcgaacgttactcggatcaacgagcgaggcgcatcgacgggacgccaggtgctggtgtccgctcggacggaggacaagagccggaatgactacacccgtgaacgcccgccggtggacgaactggggacagaatcaggagtcggtcgcggaggtgctcgcgccggcgggtatcgacgaggtggccgccatggtgaccgccgcggcgcaggccgggcgccggatcaagacggtcggcaccgggcactcgttcaccgcgatcgcggtcgccgaggaccagcggatgctgctgcaccggatgaccgatctggtcgcggtcgacgggccgctggtgaccgtgcaggccgggatgccgctgtcggtgctcaacgcggtgctcgcccagcacgggctggccatgccgaacctgggtgacatcgacgtgcagacggtggccggggccatctccacggcgacccacgggaccggcatcgggcacgggacgctcgcctcctgcgtggaggcggtcaccctggtcaccgcggccggcaaggtcgagcggtacgacccgggctctccggagttccccgcggtccgcgccgggctgggcgcgctcggcgtgctggtcgaggtgacactgcgctgcgtgccggcgttcaccctgctggccgacgagaagccgatggcgcttgccgacgtgctggccggggtcgaggagtgggtggacggcaacgaccacgtggagttcttctggtatccgtacaccgaccgggccagcgtgaagatcaacaatcgggtgccggagcacgatcggccgctgtcgcggttccgcggctggctcgacgacgacttcctgtccaacacggtgttccagggcgtctgcaaggtcgggcagcggttcccaggatcggtgcggacgatcagctcgctgaccgcgcgcgcgttgagcgcccggagttacaccgaccgctcggatcgggtgttctgctcgccgcgccgggtcacattcaccgagatggagtacgagatcccgcgcgccgccctgcccgaggtgatcgacgcgctgccccggctgatcgacgcgttgccgttcaaggtgctgttcccggtcgaggtgcggttcaccgggccggacgacgtctggctgtcgcacggctacgggcgggaatccgcctacatcgcggtgcaccagttccggggcagcccgtacgagccgtatttcaaggcgctagaggcgctctgcgagccgctgggcgggcggccgcactggggcaagatgcattatcggtccgcggcggatctgcgacccgcgtacccccgattcgacgatttcctggccgtgcgggaccgcctcgacccggcccgggtcttcaccaacgcgtacctggaccgggtgctcggcgcctgactcactcggaggaggccgcggccttgcggggtgcggccttcttcgccggcgcggccttcttggccgtcgccttcttggccggcgtggcggccttggccgcggccttcttcgcgggtgcggccttcttggcgggtgccttcttcggtgccggccccttggcccgcttctcggcgatcatctcgatcgcctcctgcagggtcagctcctccggcgtctgcccgcgccgcagcgtcacgttcgtctcgccgtcggtcacgtacggcccgaaccggccgtccttgaccagcaacggcttctccgacaccgggtcgacgccctccaggtcgcgcagcggcggtttgggcgccccgcgctgcccgcggaccttcggcgcggccagcatcgccaacgcctcgtccagggtgacggtgaacagccgctcctcgctctccagcgagcgggagtccttgagccgctggatgaacgggccgaacttgccgttacgggcgatgatctcgttgccctcggggtccttgccgaccacccggggcagcgacagcagctgcagcgcctgctccagggtgagggtctgcggcgactggctctggaacagcgacgacttgctctcgccggactgcacgtaggggccgaagcggccggatttgaccagcaccggctcgccggtcgccgggttgtcgccgagcgtccggtcgccgttgccggccaggaacagctcttcgaccttctcccgggtcagctcgtcgggggcgacgccctccgggatcgaggcgcggtcctccgacgcctcctccgccccgtcggccacctgggtgttactgcgctgcaggtacggcccgaacttgccgacccggaccacgacctgccggttctggtcgtcggtgaagagcgggatcgagttgacctcgcgcgcgtcgatggcgctcagatcctcggtcaccatcttcttcagaccgccggccttggcgatctcctcgtccgccccgccggcctggctgccgaagtagaaagaggtgaggaagtcgacggcggtgtggtcaccggacgcgatgtcgtcgagctgcccctccatggcggcggtgaagttgtagtcgaccagccggccgtagtggttctccagcaggccgaccacggcgaaggccgggaaggtcgggatcatcgcctggccgcgcttctccacatagccgcggtcctggatggtctgcatgatcgaggtgtacgtggaggggcggccgatgccgagctcctccagcatcttgaccagcgaggcctcggtataccgcggcggcggtgaggtgtggtggcccagcgcgttcagctcgtcggcggtcagcggctggtccttcaccaggttcggcaggcggcgctcggcgtcctcggcctcggcgttctcgtcgtcggacgactcgacgtaggcgcgcaggaagcccgggtcggtgatcgtcttgccggaggcggcgaagtcggcctcctcgttcgcggtggagacggcgcggatccggacgctgatcgagttaccgatcgcgtcggtcatctgcgaggcgatggtccgccgccagatcagctcgtagagcttgaactcggcggtgttcagctccttggccacctcgcccggggtgcggaagttgtccccggcgggacggatcgcctcgtgcgcctcctgcgcgttcttcgacttggtggtgtagcgccggggctgcggcggcacgttgttcgccccgtacagctcggcgatctgccggcgggcggcggcgatggcggtctcggagaggttcaccgagtccgtccgcatataggtgatgtagcccttctcgtacaggctctgcgcggtgctcatcgtctgtttcgaggaggaccgcagcttgcgggacgcctcctgctgcagcgtcgaggtggtgaacggcgcgtacggccggcggcggtacggcttctcctcgacccggctgaccgtgaacgggcggtccgccagccgggcggccagcccgcgggcgccgtcaccgtccagctggaccacggccgcgcccggcttgagctgtccggtggtcggctcgaagtccttgccgctggcgatccggtcgccgtccagcgcgatcagcgtggcggagaagttgcgcgggccgtcgaccggaccctgcacggccagcagcgcctggatgtcccagtactccgcggagcggaacgccatccgctgccgctcacgctcgaccacgatccgggtggcgaccgactgcacgcgacccgcggacaggccgcgcatcacctttttccacaggaccgggctgacctcgtagccgtacagccggtccaggatgcggcgggcctcctgcgcgtcgaccagcgaacggtcgatgtcgcgcgggttggccacggccgcctggatggccggcttggtgatctcgtggaagaccatccgcttgaccggcaccttgggtttgatcgtttcgatcaggtgccaggcgatcgcctcgccctcgcggtcctcatcggtggcgaggaagatctcgtcgacctccttggccagccgctgcagcttggcgacctgctcccgacggccggcggagaccacgtacagcgcgtggaagccgttgtcgacgtcgacgccgagccgggcccacggctggcccttgtacttggccgggacctcgtcggcgttcttcggcagatcgcggatgtgcccgacggaggcctcgaccagatagtcgggccccagataaccggcgatcgtcttggccttcgacggagactcgacgatgaccagacgggtcgtcctggcgtcactcggcacggcgctccctgcttttcgttcctgtcgggccctcggtgttccccgcccggcttcaagcacagacgttcaacgtaacgcgccggacgagtcctcattccccgggaaccccgcagtcggatggtaacggtccggccaccgcttgcgtccgaccgcgacaccgtacaccggaaggacactgttatgtcggacacaatccgggaagatcatgcacccgcgccgccgggccacaattcggacggggccgcctccggccggatcccgaccagctcggtgagccgggtcaggcggcgccggccggcgatcacgtaggcccggcggtcctcggtgacccggccggccagaccggcccggaccagcgcggcgtccacctcgacggggtccttgcccgggtccaggcccaagcggtagccgcccgggtgggggtggcccgcggcggccacccagagccgcaggcgcgggccggacaggaacagctgggcggcggccgcgggccaggccgtcgcgagggcgttcaaccttcgggagtacgcggtgcggacctcgaaacggggcggcggctcctccggcgtgtcggaagtctccccctcggcggagcgctcgtcgcgtaccgcgtcaatcgggtcttgatcttgatcttccaccggggcccaggtggtcgccagaccgcgcgcgaccagctcggcgaccagcacgtggacccgccaggcggcgtccacgaccaccgacacccgggcggtgccgcccatccgccccaactgccccggaccggccagcagaccggccaggtcggccggcgacgcctcggtggtctccgcgccgaacatcgacagctgccgcccggccggccgcccgggcgcgccacgctgcgcggaccgccgcccggccaccggaatcggcgggggcagggtctcgcgcggaatgagcggccagccggtctcgggcagcgacgtcattggcactcgggcagcgactcgaaggcccgtctcagctcgaccgagtcgagtttcgaggtgtccaggccgctctgctcgtactcactgttgagcctgtcgacgaccttgccgacctcggtgtagaagctggccgacggcgcggtggccagcgcctggatgccgtcgtgggccgaaccgtaggcgtcgcgcatgccggccagcgagccgacgaacgcgtcagcgatcttcttgccgtcggtgacatcgggcacaccggcgcgctccaccccggcccgcgccgtctcgctcgccgaccgcgcgccgtcgaagagccgggccagattctccttcgcctgaccgggcgtggtgcgggtggtcatctgctgctgggtgcggctggtcaggctgctgatctcgctgcgccacgggcgcagtgtgccgcacacggcagccgcccaggcctcggcgccgtgcccggaggagcaggcggccagcggcgggcccagcacgaggacgagagcgagagagatcgttcggaccgcgcgcatgggagcagcgtacggcctcggtaggacactccacacacctcgatcaggtcaatgcgaacgggcacccggcgcgtgccgggtgcccgtcggggtgcagcgtggactcagcccacgttgtccttgatccgcgactgcgcggccgcgtcgctgtgctgcgcgtcctgcaccgccttggcggtgtccgcggcgccgaccgcggtcgccccggccggctcgtcgcccatcgcgatcgacttccgcttgctccacaccaccgcaccggtgaccagggccaccgcgatcagcgccacgatcacgcgcagcggggtgttcgcgtcggcgccgacgctccaggtcaccacggccggcgcgatcagcagcgagaccaagttcatcaccttgatcagcgggttgatcgccgggccggcggtgtccttgaacgggtcaccgaccgtgtcaccgatcaccgtggcggcgtgcgcctcggagcccttgccgccgtgcgcgccgtcctcgaccagcttcttcgcgttgtcccaggcgccaccggagttggccaggaagaccgccatcagcgtgccggtgccgatcgcaccggccagataggcggccagcgcgccggcgcccagcccgaagcccaccgcgatcggcgcggtgatcgccagcagaccgggggtgagcagctcgcgctgcgcgtcccgggtgcagatgtccaccacccggccgtactcgggccgctgggtgcggtccatgatcccggggaactcgcggaactgccgccgcacttccatgaccaccgcgcccgccgagcgggacaccgcgttgatcgccaggccggagaagaggaacaccaccgccgcgccgatcagcaggccgaccaggctgcgcgggttcgcgatgttcagcagctggtagatctgcccctgcacgtcggcgaccttggcatcggtcagcgagctgaccaggctgttggtgtacgagccgaacagcgccgtggcggccagcaccgcggtcgcgatcgcgatgcccttggtgatcgccttggtggtgttgcccaccgcgtcgagctcggtcaggatctgcgctccggtctcgtcgacgtcaccggacatctcggcgatcccctgcgcgttgtccgagatcggaccgaacgtgtccatcgccacgatcacgccgaccgtggtgagcaggccggtgccggccagcgccacggcgaacagcgacagggtcagcgacgagccgccgagcaggaaggcgccgtacacggcggcgccgatcagcagcgccgagtagaccgccgactccaggccgacgctgatcccggccagcaccacggtggccgcgccggtctgcgacgacttgccgatgtcctgcaccggacgcttgttggtctcggtgaagtagccggtcagcgcctggatggcggcggccagcacgatgccgatcacgaccgcgccgatcgccacccactgcgggttgcggccgctgtccacgatgtccttcgcgatcccggcatccccgaacccggcgaacgaatccggcaggtacaggaaggtgaccaccgccacggcgaccgccgacaccaccgcggacaggtagaacgcccggttgatcgcggtcaggccgttgcggtcggacgggcgcagccgggtgatgaacacccccaggatggcgatcaccacaccgatcgtggacacgatcagcgggaagatcaggccgtcctgaccgaacgcggcctggcccaggatcagcgcggcgaccagggtcaccgcgtacgactcgaacaggtcggcggccatgccggcgcagtcaccgacgttgtcgccgacgttgtcggcgatcgtcgcggcgttgcgcgggtcgtcctccggaatgttcttctccaccttgccgaccaggtcggcgccgacgtccgcggccttggtgaagatgccgccaccgacccgcatgaacatcgcgagcagggcggcgccgaagccgaagccctccagcacggtcggggcgtcgctgcggaagatcagcaccaccagcgcgccgccgaacaggcccaggcccacggtcaggaagccgaccacaccaccggtgcggaaggcgatgcccatcgccgtctcccggccgcccggctccccggcggccgcggccacccgcaggttggcccgggtcgccagagccatcccggcgccgccgatgaacgagctgaagaccgcgcccaccacgaagaagagcgacctgccgatcttcacccaggtctcgttgtcggtgtcgtgcaccggcaacaggaacagcagcacgaccgcgatcaccacgaacacggcgagcgtcttgaactgccggaagagataggccgaggcgccttcctgcacggcgccggcgatctcctgcatgttcttggtgccccggccggtgcgcagcaccgactggacgaacatcgcggcgaagcccagcgcgatcagggcgaacaccagagcgacgatgacgaatacgacgttggatccgctgagggacactccgccgcccccggcggcgaggtctatcgaggtcccggacatcaatgtcctcctacacacaccgaccgcacccggtggtggacgagaccatcgggtgcattccccttcagagaacgggggaacgaaacgaccggccccgcgggcgcgggaccagcgagtagctgatgactcgcgtactgtataggtcacacgtggcgatcgtcacacggcgacccggccgtgtcgcggtgatgttcaccgctgtgttaggcctctggttcgcgggtatccgcttcggttgatcttttgcctggccagcggtctgcgctcgccagcagtcagatataaccgaaatgtcagaatttaagatagcgagaggcctggagatcgtttagctcccacgccgaagctcggtcaaagatcgaatcggcgggccggacgggtggcaatcaaagatcaacagcgagttcagatcttgatgtcgtgcgctgcggccgataattgatcgccgctcccgccgaggccgggtcacggcgatcaggccgctggcgcggcccgaacaatcgccgccacccttcattgcccgtgggtggtcaccgagaaacccggcgtgccgccgcttccctcacgttgccgcctcgctcggcgacttcgttcagccgcctcgctcagcgatctcgttcaaccgcctcgctcagggttgttcagccgccttgttcagcgttcttgttcaaccgcctcgctcagcgttgttcagccgccttgtcagccgcctcgcccagcggcttcgttcggcggcttgttcagcggcgggtgaccggccagaccatgcggacctcggtgccggcgccgtcctcgaccgggcgcacctgcaggtcgtcgacaaaaccggcgagcagggcgaagcccaccccggtcgtcaggtcgtcctcggtgagcgactcggcggccagttcgtccggcggcagtttggtgagaccgatgctggcctcgatcggggcgtggtcgatgacccgcaccgtgtacgacccggagtcggacatctccaccgtgaccaggtcagccagcccgtattgccggtgcagcgcgaccgcacgggtgcaggcttcgccgatcgccaggcgcacctcgtcgagcagtgcctcgtcgacacccgcccggcgggcgaccgccacgccgacgagccgggcggtgcgaacgtgcaccggcgccggcgagaaggacagccgaaccgtagccatcacgaagcgggaccgctgccgttgcgttcggtcgcggcctcgaccgtcgaatagatcgggaagacctggtccagcgcggtgatccggaaaatcttgagaagtggctccttggcgcagaccaggccgaaggtgccctgcgcggtccgcagcctcttcaacgcaccgaccagcacgccgagtccggtggaatcgaggaactcgacccgttccagatcgaccaccacgtcccgggcgccggcgtcgaccagctcgatcaggcgctcgcgcagccgtggagcggtgtaaacgtcgacctcaccaccgacctcgagcaccgtgtgcccggcaacggtccgggtcgccagcgacagctccatcggtcctcctccctgatctcccccgcgaatctaaccaccgaccggcatcgggcgacgcgtggcacccaccgtcctacccgtttggggccgggcgcataccgacgtccgccactcccttcgcagcaccggaacggtttgggaacggcgggtcgatggtgtcagagtgcttggcgtgactgccaccgcctccggtcccgccgagctcctgcaccgcctccgggcccgggccggcaacgccgggcagtccccgatcacccacgtcgagcgggtcccggcccgcaccggcaggcccgcgccgtggccgtcctggacccaccccgaggtgcgtgaagccttcgcgcgccagggcatcaccgcgccgtggcagcaccaggcggacgccgccggcctcgccttcgagggcacccatgtggtgctggccaccggcaccgcctccggcaagtcgctggcctaccagctgccggcactgaccgctctcaccaccgatccgaaggcgaccgtcctctacctggcccccaccaaggcgctcgcggccgaccagctccgcaaactgacccgcctcggcctggccgacatccgcccggccgccctggacggcgacgtgccccgcgaggagcgcgagtggatccgccagcacgcccgtttcctgctcaccaacccggacatgctgcaccactcgctgctccccggccactcccggtgggccacgttcttccgccgcctgacctacgtcgtcatcgacgaatgccacgcctaccggggcgtcttcggttcgcatgtggcccacgtcctgcgccgcctgcgccgcaccaccgcccgttacggcggctcccccacgttcatcctggcctccgccacgtccggcgacccggccggcagcacctcccgcctgctcggcaccccggtgaccgcggtaaccgaagacgcctccccccgcggcgcggtcaccttcgccctgtgggagccgccgctgctccccccggagcccgccactcccaccttcgtgcccccgccgacgattcccgtcccggcccagcccaccgccccggccgttgccccggcccggcccaccgccgcggcccggcacaccgactcctcccggcccaccgccgcggcccggcccaccgactcctcccggctcgccgccgcggcccggcccaccgagccgctcacccccgcggcgctgtctccgctggccgttccgcctcccgaggccgatttcgacgaactggatctgccgccggtgcgacggtcggcgctgcgggagaccgcggatctgctcaccgacgccgtcatcgccggcacccggacgctggctttcgtccggtcccggcgcggcgccgaggtggtcgccgcggtggcccgtcgttccctggacgaggtggttcccggcctgggttcccgggtcgccgcctaccgcggtggctacctgcgggaggaccgccgtgccatcgaacgcgccctactcgccggcgacctgctcggtctcgcctccaccaacgccttggagctcggcgtcgacctggccggcctggacgcggtcctgatctgcggctggcccggcacccgggcttcgctgtggcagcaggccgggcgcgcgggccgggccggcggtgcggccctggccgtcctgatcgcccgcgacgatccgctggacacctacctggtgcaccatccggaggccctgttcggccatccggtcgaagcgaccgtcctggacccggccaacccgtacgtcctgggcccgcaactctgctgcgccgcctccgaagccccgctgaccgagaaggacctgccccttttcggccccgccacccgcccggtgatcgatcagctggtcgccgagggcgccctccgccgccgcccgtccggctggtactggaccgaacgcggccgccccgacgtggacctgcgcggctcgggcggcgccccggtccaggtggtcgaagccgccaccggccgcctgctcggcaccgtcgaccagggctcctcccacgtgatgctccacgagggcgcggtccacctgcaccagggcaccacctacgtggtcgacgagctggacctggaggacgcgaccgccctggtccaccaggaggacccggactggagcacgcacgcccgcgacgtcaccgacgtgtcggtggtccgggtgttctcctacgccgacgccggcccggtcggcctgttcctcggcgaggtcgacgtgaccagccaggtcgtctcctaccagcgccgccgcctgggcagtggcgaggtgatcgacatccgcccgctggatctgccggtccgcgagctgcgcaccgtcgccgtctggttcaccgtttccccgcaggccctggccgccgccggcatcgagccgaacgacgtccccggcgcgctgcacgccgccgagcacgcggctatcggcctgctcccgctgatggccacctgcgatcgctgggacatcggtggcctgtccaccgccaaccacccggacaccgaggcccccaccgtcttcgtctacgacggccacccgggcggtgccggtttcgccgaacgcgcccacgccaccgccgccgcctggctcaccgccacccgcgaagccatcgccgcctgtgcctgtgactccggctgcccgtcctgcgtccagtccccgaagtgcggaaacggcaacaaccccctttccaagcccggcgcgctcaaagtcctcgacaccgtcctcgccgccctccccgaaaccccctgaccgccccgccctctctccgggccggccaggatccgtcgctgtcaccggcccgtcaaccgggccggcacgggccacggctgtggcggccgcgcgcaccgagggaaccggcacttccgtccggaccaccacctcaagcccggtcacctcgcacgaggtcagccgcgcaccgttcgcccccgcgtatcgcgccgcggccgcacaagccgcccccgccccctcgacggcatgaccggctccggcgagcgccgcgaagtccgccgcattgcgcgcggcgtgccgggccaccctggcctccgccactgcggcgcccgccatcccggccgccaccagaaacagccccaccgccagcacgaagatcgaagccgacccccgatcacggccaccggccgccaccggcctcacccgccgagccatcggcctcatcccctttcccaggcccgccgcgctccccctgcctcgcggtcacctcaacgtcgaccttcgatgggctgcgggccgggttcccgggcggcgaccgcggagcccaccacccggatcccgggcagccgggcgccgagcacacgaacccgcacggtcaccgtcgccgtgacgctgtcccgatctccgaccacccggatgtcagccccgtccggagccgtccgggccgccgaaaccgaatgctcgccccgcgcctcggccagagcggcctcccgggcggcatccaggcattgcgccttggtgaccaccgcggtcaccgccgtgatcccggcgaacatcagcaccaccagcgccggcagcccggccgcgagctccaccgtgaacgcaccccgatcccggccgggcccgcgtcctgcgcgccgatgcccgtcccgtccccggccggcccgccggcgcccgatcacttcagcgcccgaagaatcatggtgttcagtgcgctctggatcgacgtgctggtcagcaccttgcacaggagcagtgcgaggccggccgccccgagaacccccaccgcgtactccacggtgctgtatccggcgtcgaccgcctccatgcgcagccgccggaacgtcatgacgaatcgatgcaaaagaatcctcctgagtcgggagaagcggccggatgccgcgcctcgggtcacgcttcaacgccttcacagcaaccggccgagcacggcgatcagcaccggcaccaggccggccagcaggaaggcgggcagaaaacacagtccgagcggcaggacgatgaacaccgccgcgcgttccgccgccgcctgcgtcgccaccgcacggtcggcccgcagatcaccggcgagccgttcgagcgctgcggcgagcgccccgccgctggcgctggaccggatcgccgtcgcggtcagccggtccgcgccgggcaggccggccaggtgcgcccacgcttcggccggcccggcaccgagtcgcagcgaccgggcggtccgttgcatgcgcgcaccgagcggcccgcccaccgcgtcggcgaccgcggctgcggcccggtccaccggcgcgccggcccgcaacgccgcggccaacaggtccacgccgagtggcaggtccgcacccgcctggtgacgttcccgccggacgtcggccggttcctggttccgcagcgcgcgttccacgccgatcgcggtcaccaacccgaccggcaggccccaccagccgccgaccagaccggcggccgaggcaccggcgagcaacccgagcaaggcatgccgtcgccgcgccggcaccgggtcggcagccacatccggcgacctcgaccgggccgcatcggaaagccctgccgatcgcaatcgccccagccggcgtccggcccgcccccaccggctcatgtgcccacctccatcggatggcccgctgccgacggcgaagctctccaccggaccatccgaaccacccggagagtccggccggcccgaaccgaccgggcccgctgatcgcgccgagcggctcgggtccgccgcggagcgggcacgacccggctcccccggcgcaccgggacagccgctcgacaggcgctgcctgaaccgcccgccccgagcagcgccgcgacgcaacactcgcgcagcggcacccgaaccggcccacccggccgcagcaccgccgacgccccgcacaccgccggctctccacatccggccgccgctcccggcgacgcgggcaccccgcacggctcggtcatcggcgcggcccgttcgcgatccgccgcgcccactgcagtccggcgagctgcaacgccagcgctccgatcgcgcagaccgcccccaaccgcgtacgcagcaggatgtgcagcgagtcggcaccgatcgcgtacccgaggccgaggccacccaccggaagcaccgccagcagcagggatgtcgcctgcacccccgccgcctgggcggcggccgacgcgcgtgcccggtccgcggcccgcgcgtccgcctcgatccgctccagcagatcggccgcgggcgccccggtgcgctcggcgagacgccacaccgtggcgctgagccgcgcgatccgctcgtcgccgtccagcccggtcgacggcacgccgaaccccggcggcaacccggcccgcagatccgccaccagggacgacagcgcgtccagcgccgccagacggccggccgcggcccgcttctgccgagtccggcgcacccatgcggccccgccgatccccgcgtagaccgccccgccgacggccgcgaccggcccgccggccaccagcgcgaccagtgccgtcgctccggcgagagcggccgccccgcgccggtcgggttccggcagccgcggccgaggcagccggagtccgggtgaccgcccggagagccgggccagcgtcccggctcgtggccaggcgatcaccaccgcgcagccgagcaggcaggccaccagcaccgcgatcatgacgccgccggcaccggtggagcggtgatcccgcgggcccgcagcatccgcgcgaacggaccgggcccggggccggtggtccggtcccaggcggtcaccacggaggtgagccgttcggtcccggcgggcaccaggatgccgatcgattccagcagccgtgcgccaccgacccgccggaggtgcaacaccacctgcagggcggccagcacctgcgcgtgcagcgcggcccggggcagcccgccgagcagcccaagcgcttccagccgggccggtacgtcgcccggggcgttggcgtgcagtgttcccgcgccgccgtcgtgcccggtgttcagcgccccgagcaggtcgacgatctcggggccacggcactccccgatgaccagccggtcggggcgcatccgcagcgcctgccgcaccaggtcggtcagcccgatcgcgccggcgccctccacattcgccgtgcgggcctgcaacgccaccacgtgcgggtgcaccgggcgcagctcggccgcgtcctcgaccagcacgatccgctcggtcggcgggaccagcccgagcagggtggcgagcagagtggtcttgccgctgccggtgccgccggtgaccaggtaggccagcccggcggcgacgacagcttcgagcagtggcgcggccgcggccggcaccgtcgcgtgggtgaccaggtcgccgaggctgaacgggcgctgccggaaggtccgcagcgaaaggtacggcccgtgggtggcgaccgggggcagcacggcgtgcaggcgggtgccgtcgggcagccgcgcgtccgcgtacggctggccgtcgtcgagccgccgcccgcaggccgcgaccagccgctgggcaagccgccgcacgtcctccggatcgccgagccgcaccgcggcccgctgcaacccggcgccccggtcgacccagacctgcacgccgttcaccagcacgtcggtgaccagcgggtcgctgagcagcggcgcgagcggaccggccccgatcatctggtcgcgcacccggtcggcgaggcgcagcacggcgtggtcaccgaggacctcaccgtcccggcgcaccgcgctcaccacggccgccggggtggcttccaccccgtcgtaggcgagctgccgccgcacccggtcgaccacgctcatgccgccaccgccggcggccgcatcagttcgtcgaccagccgccggcagagctcggcgagcggccctttcccgctcgtggccggcgctgtcccgcgttcgaggtcctggcacatcgccgggtcgggccgcagcgccccggccaggggcagaccgagcgtctgcgcgatgtcgcggggccgcagtcgcccgggggcgggcccgcgcaccacgaccgagacctgctcgcagtgcggccggatctgggccagggtccgtgccgcggccgctgtggcccgcagctcggcggggaccaccagcagggtccggtcggcggcctgcagggccagcgccgcggcgtcgtcgagttgccggggtaggtcggcgacgatcacgtcgcgaccgcgccgggcggcgtccagggtggcggccatcgcctcggccggcaccccggtcatctggtcccggtcgaaggagagcagcaccaggtcgccgcggtgtggcagtgcgttgagcagggccggcgggtcgacccggccgccggccccggcgagcccgggccagcgcaggccgctgacctgctcccagccgagcaccaggtcgaggccgccgccgagtgggtcggcgtcgatcagcagggtgcggcggcccgcggcgaccgcggtcccggcgagtccggcggcgaggatgctggccccggcgccgccgcggccgccgatcacggcgagggtgcgggagacggcgggcggccggggccgggtggcgagttgctcgatcagccacggctcggcctcgggcagcgccgcgacgtgctcggcgccgagggattccgctgtgggccacagtccctcgggtgggctgccgcgcagcacgacgatcacccgggatcggcggggcagccgggcccgcgcgcaggccacggccaggtcggcgccgatcagcacgatcggggcggacgggaagcggagtcgggcggcggccgggtcggcggccacgtccgcctcgctgtccgcggccgcggccagccgcagcaggtcgtcgaggaggtcgccgtcggcggtgaccaggagtgggcggagcggctggggcatcgcggcctccggtggtgagcgcgggttcgggcccgcccaacctcccgggcggcgccggtcccgggcaatcacgatctgccggcctgtggataactcggagcgctgtggacaactcccgcgggtcggtgggatctgctatgcgggcgggctctccaccttcggcgaatggaccggcccgagttgggtatgttgtgccgacacggaccgatggagtggggtatggagagctcgatccggaccacgctcgcggacgacggcacggtcacgatcacagtgttcggagagatcgacttctccaatgccgacgaggttgccgacggcatccggcacgcggtcgccgactggtcaccgccgctggtccagatcgacctgcgggatgcgtcgttcatcgactcgaccggcctcggcgcactgatcgacggctaccgaaccgccacggagagcaacgttcgatacctggtgatcaacgccagccccactttccggcgcgttctcaccgtgaccgggctcagcggtttcttcggggtcacggacagcttcgaggagagcgccggccaggcgcacgcgaccggcgcctgagcccccatgaagggaacgacccccgccgggggagacgggggtcgtcctgggattcggctccgggggggtcgagccgaatcaactcggccaccgcgggggcgcggccgccgagagccatatcggtgaggcatacgggacgcgacggtaacaacactcttccccatcgcaaacacaagtctgcctcagactgaggcagccgtcgagtaccgaatgtgactcaatgaagcgtccctgcctgtctgcccgatttcactgcgcgtcacgggaaacgggtgctcgcggatcgacgggttgcggctacactttcggcccgtgggccccagcgccgcgtttttcgacctcgacaagaccgtcatcgccaagtccagcgcactggccttcggacggccgttctatcgggatggcctgatcacccgccgtgacgtggtgaaatccgcctatgcccagctgatgttccggctcggcggcggcaccgacgagcaggcgatggcccgcacccgtgactatctggccacgctctgcaagggctggcggatcgagcaggtgcaacagattgtcgcggagaccctcaacgagctgatcaatccgtacgtctacgccgaggccgccgcgctcatcgccgagcaccaggcggccggccgtgacgtggtgctcgtctcggcgtccggcgacgagatggtccgtccgatcggcgagctgctcggcatctccgacgtgatcgccacccggatggccatcgtcgacgggcgatacagcggcgacgtcgagttctacgcggccggcccggccaaggtcgtcggcatccgtgcgctggccgccacccgcggctacgacctcggccagtgcttcgcctattcggattccagcagtgacctgccgatgctcgaagcggtcggccaccccagcgtcgtgaacccggaccgcgccctgcgccgcgtcgccgccgaacgctcctggccggtgctggagttccgccacccgatcgccctcggcaaacgcctccgcgaccgcccggccgtcccggtcgccgccgccctcggcgtcggcgtcggcgtcgccatcggcttcgccctctacggccgccaccgccgcgcccgagccgccgcggcctgagacgccccacccgcctgcggccgcggcccgagaccgctccccttcaaaacccgattgcggcggtacgccgtcaagctccccaccgcaccgaacccaccgccccgcacagtggacgccaacccaccgccccgcggttcgggcgcagcggcaggcacaaagcgctcgcgatgcaggcgcagcggggctgcaacgggcggtggttttcggttcagtgggcacacgcggatgtaggaccggagggctgagcgttctggacgcgtagcggccagctcggcccgcagggaccctcggcgggagcggcggtcggtgatcagcgcggacatacgacatcatgaatttgatcttgaatgggatcgtgtaccggcaccgccccggcgtcccccggaagctgctgcaatgcgatgaccagcgcggatgtcttcggtctgagtaatcgatgatcaccagatttgctggcccgatacctggcgatcatgccgggagcggcgtagaaaggagtcgcggggccaacgagaaatcggcaccaccggcagtcggagtcaccggctttccgggcgtccaggatcactggatggccgatctgctggacggtcgatgatcgggtctcgtgcacggccaccgggaacccacgcgcgatcagccacggcaggcacgttgcgacgggacctccgccacaggtggtgcttccgccttcatggggatcatcgccaccaggctgctggaccgtcgacaacgacccaggtgcacgcttgataacccggtccggacgcgcgaagccggcgcccccgacagggacgccggctcttcacttcccgaggatgaatccgatcccggcgacgtcggaagcttgccggtgaatccgatcccggcgacttcggaagcctgccggggacggatcataggatccgagacccggggacggatcaggggatccgagacgtatgcagtgctgccacgacctgcgaccgacgcccggcccgcagccatcgcggcctatcgcgccgcctggtgacggtggcggatctcctggtagacggcgcggaagaccttgggccgcgagtggaagtcgaccccccgctcccacaactcggtgttgatcgtcgccccgtccagccgctccagcaggaccgtgttgccgccctcgatctcccacggcccgagccgatgggtcgcgcggtgcaaccggaccccggcgatgtcccgccagcgcagcatccgggagcgcagcaggccgcggacgagcacgccgtccgggctgacgtagacgccgagttgcaggatccgccaggcgccgatcacccagaccgcggcgagcaggcaggcgaccacccgcacgccgtggcccatcaggtcgaactgccggacgctggcccaggtcagcatcgtcagggcgaacgcctcccaggcgatgaccagccaccggccggtgccggggtcgtagggacgcacccagttgtcagccacccggaaattatgcgacgccgattcgatctcaggtcagacggatgccaataccgagtcgccgatggcggtgatctcctcggcgccggcggtgatcgccgcggcgtagtggcgcagccaggagcggacgccgtccggggtgccggtggcgtaggcgccggccgagccgacgtattcgggttcgcgggcgaggtggccggtttcgacgccgaccaggccgcgcgggtcgaagccgcggccgatcagggtgagccgggcggcggcgcgggcgacgacgccggccgggccggcgaacgggcgcagggtgatcagctcggcgtgcacgatcgcggcgagcagcagcggcggggtctcctcgttgccggcgaccaggccggcgagggcgtcgatgcgttcggcgccgccggtgagccggcccagctcgtcggccgggacgacgccgcgggcggcgagcacgtgaagcttggcaaggacctggcggggagcacggggccagaggtcgaccaggccgccgaggccctcggcgacccgcagggcgccctgcacgaccgggtcggtgatcgtgccggcccgcacgtcgtcgaggtcgtggacgttgccttccagggcggcgctggcgaccgcggcgcgcaggctggcctcggcggcgacctggccgccgtgccgccgcagggcccggtgccgcatggcggtgtcgacgctgtcccgggccgcggccagggccggagcgacgtcagcgagatcgagcaggggagctagtggatccacctgcacacggtaaccggtaaaaccgcggaaacgcggggtgcacaaatacgagtggaactggcaagattcgcgcagtaccaatcacctacgcgtcatccggcgcgcacccactagtgtgcaacgtagagaccccggtcatggcagaggagccgccctcatgagcgagacactggagaatttgtactcggagacgcggcagttcccgccgcccgccgacctcgcggccggcgccaacgtcaaggccgaggcgtacgaggaggcggctgccgaccggctcgcctactgggagcgccaggccgagcgtctgacctgggcgaagccgtgggatcaggtgctggactggtcccacccgccgttcgccaagtggttcgtcggcggcgagctgaacgtggcgtacaactgcgtcgaccggcacgtcgaggccggccacggcgacaaggtcgccatccactgggagggcgagccgggcgatacccgcacggtgacgtacgccgagctgctgaagctggtctcgcaggcggccaacacgctgaccgagctgggcgtgcgcgccggcgaccgggtcgccatctacctgccgatgatccccgaggccgcggtggcgatgctcgcctgcgcccggatcggcgccacgcacagcgtggtcttcggcggcttctcggtggaggcgctcgccacccggatccaggacgccgacgccaaggtcgtgatcaccgccgacggtggctaccggcgcggcaagccgtccgcgctgaagccgaccgtcgacgaggcggtggcccgctgcgcgagcatcgagcacgtgctggtggtccgccgcaccgggcaggaggtcgcctggacggccaaggacaagtggtggcacgaaacggtcgagaatgccggctcggagcacgtggcgcagccgttcgacgccgagcacccgctcttcatcctttacacctcgggcacgaccggtaagccgaagggcatcctgcacaccacgggcggatacctgacgcagacgtcgtacacccatgatgcggtcttcgacctgaagccggagtcggacgtctactggtgcaccgccgacatcggctgggtcaccgggcactcctacatcgtgtacgggccgctctccaacggtgccacccaggtgatgtacgagggcaccccggacaccccggaccgcggccggttctggcagatcgtcgacaagtacaaggtgtccatcctgtacaccgcgcccacgctgatccgcaccatgatgaagtggggcgacgacatcccggcgaagtacgacctgtcctcgctgcgcgtgctgggcagcgtcggcgagccgatcaaccccgaggcctggatgtggtaccgggagcacgtcggccacgagcgcaccccggtggtcgacacctggtggcagaccgagaccggcgccgtgatgatctccccgctgccgggggtgaccgcggccaagcccggttcggcgatgaccgccctgcccgggatcagcgccgacgtggtcgacgacaccgcgaccccggtgccgaacggcggcggtggcttcctggtgctgaccgagccgtggccgtcgatgctgcgcaccatctggggcgacgaccagcggttcatcgacacgtactggtcccggttcggcgcgggcgccggcaacggcgacaagtggatctacttcgccggtgacggggcgaagaaggacgaggacggcgcgctctggctgctcggccgggtcgacgacgtgatgctggtgtccgggcacaacatctccaccaccgaggtggagtcggcgctggtctcgcacccgtcggtggccgaggccgcggtggtcggcgccaccgacccgacgaccggccaggcgatcgtggcgttcgccatcccgcgcggtcacgtggcgaccgagggcgccgccggccaggagctcatccaggagctgcgcaaccacgtggccaagacgctcgggccgatcgccaagccccgccagatcatgctggtcgcggagctgccgaagacccggtccggcaagatcatgcgccgcctgctgcgcgacgtggcggagaaccgctcgctcggcgacgtcaccaccctgcaggactcgacggtgatggacctgatcagctccggcatgaagtcgtccacatcggaggactgaagcccgctgcgggagggccggtgacgccgcacgcgtcgccggccttccggcttcccgacgccgatgttatggcgccggcataccacgtaaccatcatctatcaatcgcgatctcccaccccgtacatcgactgatttacctacgttcagaggcagtcccgaaccacgggatcgtttacgcctggccgtcgctgcacccagcgtccggccgcataacggaggtaatcagtgcgcaaggtggtcgcaggactgctcggcgccgcgatggtcaccagtgtcggggcgtctttcccggccacggccttcgcggcgcccccggttgacaccgccccgtcgacctcggccgacaccgtgaacgtcgacgacctgccgcagccgctcgaggccaagcgccgcgagctgcgccagcaggcggtcgccgacgtgatcagcggcaaggccaagatcgagaaccggcacggcagccaggtggtcaacctgggccgagcgccgagtggccggggcccgctgggccacatcgggcagaaccagtacgtcgagctgggcaacgagcgcaccgaccggatcttcgtgatcctcgccgagttcggtgaccagcgggatccggcctacccggacaaggacaccgacccgaccacggccggcccgacgacgttcagcggcccgctgcacaaccagatcccacagccggaccgcaaggtcgacaactcgacgatctggcagtcggactactcggcggaccacttccgccagatgtacttcggcaccggcgccggcgccgagtcgctcaagacctacttcgagacccagtcgtccggccggtacagcgtcggcggcgaggtcaccgactgggtgaaggtgccctacaacgaggcgcggtacggccgctccaacgacccggtcaaggacgaggacaccaccaacccggccaacgacccggccgtctgccactccagcacctgcaacaacacctgggcactcgtccgggacgccgcgaacgcgtgggtcgccgaccagaagaaggccggccgcacggacgcgcagatcgccgaggacatgaagtcgttcgaccagtacgaccggtacgactacgacggtgacggcaacttcaacgagccggacggctacatcgaccacttccagatcgtgcacgccggcggtgaccaggccgacggtgacccgcagcagggtgaggacgcgatctggagccaccggtggtacgcctacggcaccgacgtcggctccaccggcccggccaccaaccggctcggcggcaccgagatcggcaacaccggcatctggatcggtgactacaccatccagccggagaacggtggcctcagcgtcttcacgcacgagtacacccacgacctcggtctgccggacgactacaacaccgacggcgaccacccgggcgacaacccgaacgagtactggacgctgatggcgcagagccgcctcaacggccggcacgaccagggcatcggcaaccggccgggcgacctcggcgcctggaacaagctgcagctgggctggctgaactacgagaaggtggacgccgggcagaagaaggtcgtcaacctcggcccggaggagtacaacaccaagaagaagcaggctgtggtggtcaacctgccggagaaaccggtctcctacgacatgggtgcgccggccgccggcaccaagcagttctactccggcaacgccgacaacctgaacacctcgatgaccacgacggtggacctcaccgggaagaccaccgccgcgctcagcctcaagggccggtacaacatcgagaccggatacgactaccagttcttcgaggcgtccgcggacggcggcaccacctggaccaaactcgacggcaccgtgggtgacaagccgttcccccgggacgccggcggcaacccgggcctgaccggcaacggtggaaagagctggtcggacatcacggtgccgctcaccgcgtacgccgggaagaagatctcgctgcggctgcggtacgtcagcgacagcgggaccaacaagggtggtttcttcggtgacgagatcaccgtgtcggccgacggcgcgacgctgagcacggacggcgctgagggcaacggcgtgtggaccctggccgggttcaccgtcatcgggtccaccgtcgtgcagaactacccgaactactacatcgccggttaccgcagctacacctcgtacgacaagtacctggccaccggcccgtacaacttcgggttcgccgacaagccggactgggtggagcactacaactaccagaccggcctgctcatctcgtattgggacacctcgcaggccgacaacaacacgccggcccacccggggtcgggccgcaacctctacatcgacgcgcacccgaagccgttcctggctccggacggcaagccgtggcgcgtccgcgtgcagatctacgacgcgccgttcgggctgtacccgaccgacggcatgctgctgcaccaggccggcaagccctcgctgatcacgccgcagtggggccggacggtcttcaacgacaaggacaagtactactacgacgagctgcccaaccagggcgtcaagctccccgcggtcggcgtcaagatcaaggtcttgagccagctcggtacgtcgatgaccgtggccgtctcctgacccaccgcaccaccagcgacgcccggggcccctacgctccgggcgtcgtccccttttccacgggaacccgtgcgcgccgggacgcgtcccaccgatgcgctcgtcgcgcgggaaggatgggcggaatgcgcagtcacctggtccgggccgggctcgccgtgatcacgggggcgctggtcgccgggtgcggagccgccccggccgccgtgccaacggccgatccggcgccgctgcccaccctcacccgcccggtcaagccgccccgggaccccaccgacaccaagccgaacaccggctggctgaccggtgtggtcagccggggcggcagcggtccctgttacggcttcacctccgacgacggcgccgcgttcgcgctgtacaacggcgacggcctcaccctcaccgagggcgcccgggtccaggtcaaactggagtcgacgctgctgaagatctactgcgggcccggtgacctgatggcggtgaccgcggccgcgccggtcggatgatcacgctccggttcctgagtgccgcgcgccggtcgtgacagggcagcataggctggccgcatggacgaatcggtggtgatggcggaagggccgtggacccaccgcttcgtcggcgccaacggcagccggttccacgtcgccgagatgggctccgggccgctcgtcctgttcctgcacggcttcccggagttctggtgggcctggcacgacatcatgacccgggtcgccgacgccggctaccgggccgcggccatcgatctgcgcggatacggtcacagcgacaagcccccgcggggatacgacgggtacacgatggccgccgacgtgaccggcctgatccgggccctgggtgagcgctccgccacgatcgtcggcgccggcgccggcgggatgatcggctgggccgccgcggccttccaccccaaactcgtcaaccggctggtggtgctcggcgcggcccacccgctgcggttgcgggccgcgctgttcgccgacccgcgcggacagttcgcggcttccgccacgattctcaaattccaggttccgcggtacgagcatgtcctgacccgtgacgacgcggcgctcatcggcgaactcatgcagcactggagcagcccggagtgggcggccaccccggagttcgccgactactcgtaccgctgccggcaggccatgcagatcccgcaggcgtcgttctgcgccctggaggcgtaccggtgggtggcgcgcagtgccctccggctgcagggctaccgcttcgtgaagctgatgcagcagccgctcgggatgcccaccctgcagctgcacggttccctggacacggccatcctgccgcgcacggcgcagggctccgggcggtatgtgaccgcgccgtacgagtggcggctgctgcccggtgccgggcacttcatccaccaggaggcgccggacttcgtcaccggcgagatcctccgctggctgaagacgccctagccgcgcccacccgtccgccggccgctcgtggctttccggcggccggttccggttcgctcagacccggtgctcgtaccggtcgcgaatctcgttcgccggggcccagccctggtagacgccgtagtcgaactcctccagcccgagccggcgggccaccggcgcacgcccgccggtgtactccagccgcagccaggtgtccgcctcggcgagcacgatgaacggctctccccgccaggtgcacatggtccggacgtacgccacctcgtcgtactcgtccggctccagcacccgcacgtaccgcccgggcttgacctcggcgaaaccctccgtcgcctgggccgtgtagatccgcaccctgtcgccgtcgggcaccgcgtcgtactcctgaccctgccaggacaccacgtaaccgtcacgcatcactgctcacccacccggcgccagagcggtccgtccgcgtcgaagatcgccaccatgcgttcgttgccgtccgcgtccagacgccacaactgggcgccgtgcggcagccgcacactgtccaccttgaactcggcgatcacgtcgcggccctcacccggggcgaagccgttgccccggaacggcggccgctcgatcacccagccgtccatggcacgcagcgcctgctcgttctgtccgccgtagggaatccggtacaggctgggccggaatgccggccagcgcagcacgaacgcctccttggcatccgcctggaacggcgaaccgtcgtagctgaggcccagcgcaccgaacagctccgccggggtgcgcagatgctcgacctcggacgcgcggtgcacgaaaccggccacccggtcgtagccccggtccaggtagtagtcgacctggccggcggcgatcgtcttctgcatgaccgtggcgtgctgcgcctcgtcgctggccggctccggggccggcacgacagcggccggctcctcggcggacggcgactcgatcggctcggcgccgagaccggcctcggtcgcccagttcgcgagcgcgatgatctgggtgcccggatacttcgcgccgaccggggtgcccgggttgacggcgaacgaccagttcgggtcgggccagttgcggatcagctcgtagaaccggacgcccaccgtgcgggtcggctcgccgaaatgctcggacagccggtccttgctggtgaagacgaccaggaacttctcgccctcgacctcctccggctggaacgcgaagccggactcgccgggcgcgctgcccgggcgggagtggtgggccaccgggaccaggacgtgcgccagcagcagcgtggagaggaagacgtcggtgttcccggcgtccgcggcgtcctgcagctcccgctcggtctcgttggccgggacgaagtcctcccgcgcccggccgccctgcccggagctgccaccggtcgacgaccccgcgatgcccagaccggaggcgccggaggtcggcgcggccgtggtctgcggggtcagcgagatgatctgtgtggcgtgggcctgactggcatacgccgaggccgggctgccctgcggcggcatcccgaaggccgggccgggcgccgtcggagcgctgtaggcggctggcgccggcgctgaggtcccgccgtgaccgcccggaccggacaccggcgaagcaccgtagccatccgaggccggagcgccgtaacctcccggagcgggcaccgcgggggcgctgtaaccgccgggaacgggtgtggaaggaccggtgtagccggctggcggggagctgtagccggcggggatggacggcgcgtaagccggagcaggaccggtcggaatggcatacgccgaggcaggactgccgggagcggcatacgccgaggcaggactgccggtggctgcgggcaagccgttggccacgcccggagtgccggcacccgaaagggggacgccgggagcagccgcaccggagatcggcgcgccgagagcagccgaaaccgggacaccgggagcagccggccccgaaacgggggcatcgggagcgggcgggggtgaaaccggagcacccggagcaggcggagccgagatcgggatgccgggaacagccggagccgaaaccggagcagcggcagcagccggagccggagcgccggcagcggccggagcgggtcgcccctcggggaagccggacggaccggagccggacacgggcgccccggacgggccgaggccggaccccggcgtgccgggaccggaagcgccgccgtagccaccgggaatgccgccacggtccgcaccgggagcgccggggatcaccggcggcagcaggccgggacgcccgccgggcgccggtcggtcaccgccgccctgcccgagatcagaacgctgcggcagcgccggcgcgggcccggacggcccgaatcggtccgccggtggaacatcccgctgcgcgaggccgggatccggagcgggcgtgtgcccaccggtgagcgcctgcgcggcggccgccatcgacgccggccgctccgaaggcggagtgacctgacggcggggcagcccaccgttcgatccaccgggcgaagccgcaccgggggacggcgcgcccgaacccggggcaccgagagccggcgagcccaggcctggaccacccggggccggtgcgctctgcgcggccgcggcctgcggagaggcgggcccctgcgggaagccgggcggcggggcggaggcggagccgggcatcgtccgtgcattggtgaacccggagaacgacgtcgtctggctgggcccggccgcctgaccgggctggcgccggggcagatccgaaccgccacgcgacggcagcggagcggcagccggcgcgccgagcccggacgatgcgccgggacccgccggagcaccgaggccggacggggctggagcccccgggctcgccgggtcaccggcccggccgccgccgatcgccgcccagttcgggtcgacctgggcctcggccgggtcgtacggcttgacgtgctcggggatcggcggggtgttggccatcggagtccgcaccgggagcggcgcgttcaggtcctgcaacggcccgcgcggatcgttctccggcccgaacggcatggagtccgaattccacccgggcgtggccgaaccgctgccggccggagtacggccgggcagcccgccgggcacaccgggcacgcccggcgcctggtaggcggccggcggctggtcagccgcgggagcggccggcgactcacccgcggccggagtgcgcaccggcagcccggagggagtggtcgaacgggtgggcaggctcggcgcacgcaccggaagcccgctcggcgtgttcatcggcgcaccacccggctgcccgcccggagcaccaccgagttccccgccggaaccgccgggggcagcggcgaattgcccgccggaaccaccgggaccggcaccgagctgcccgccgggaccgaactgcgcggcgccggccggaacaggcgcgccacgctggggcagagaagaggggaccgccccgggctgcggcggccgagaacctacgccggacgcgccgccgggaccggccggatgacccggccccccggacgcggctgctgccgacgtctcatgggtcggcccgccggggccctcaccggcccgcttggccgcgagcgcggccgcaccgagctcctggatcttggaggtgccgtggacctcccgccccgggccgcgggtgggcagccgcaggtcaccgcgggctagctgggcgacgaaccaggcggggaggtaaccctcgatcggtagaccggggttgaccgccagccaccactccaggttgggccaggtgttggcgagctccgcgtacgccacccggcgggacgcgccggtgtagtcggacaggcaggcacgcaacgcctcctgtgaggtgaacgccagcacgtgcgtgcgtccgccggtgctccaggtgccccagccgagcggtgccagacccgcgagcgcgtcggccgagaccggcagcaggagttcgacaccagcgaggatgcggaaataggactcctggtcgtcggtacgcaacgcgtcgcgcatcgcgacctcagcgtcggtaaccggctcccactcggacacgtccacctctccccacgcgtacgactgagccatctcaacgcgtataacctacaaggccagaccgctatgacaatgggcggcagtgcgctgatggccgagttgtgtccggacatgtccggttcccggccgcaccgagcaggtacgcgcgctccaatcgcccggcgcaatgatccaacaaccgatggtagccgtgtcaaccgcccggaccagtacgcgaacgggcgacctcaacccacccggaacggacctttgggaccgcccgaacgggtacgccacggcgtcactggaaccgttgggtagccgcccgttcggtggtcaggtagtcggtggccgactcgtccaccgccagcctgatccggctgaggatggcctccaggtcagcggacgcggcgcgccaggtggcctgccgctgcgcataggcatgctgcgcctcgccggcccagttcgacaccagcggcgcggcatcctgctccagttgcgcgagctgatcgcgcagggtgccgagcgccttgtcgatgttggcgccggcctgctgcagggcgccgaagttgacgagcagaagtccgtcgttcacgagaatcctcctggagtgaatcggagagcgggccggagcggggtggtgctgaaaagtcagagcggcagcgtgaaggtgccaccggtgcgggcgacccggctggcggcctcggagtcggcggcgtgatagccggccccggacgcccgaatcgactcggccgtctcggcgagtgcgttgttgaggcgctgcagatcctccgcgtactgcctcttgacctgctcgaaggctgccgcaccgaggcccttccacgtgccgttcaggtcggcgagctcggtcatcagcgtgcccagcatcacctgcaggacaccgttgacctggtcgaatttcccggcggtgcgggccatcaccgtggtctccgcttgggtgtaagccatttctgaggtcaccccccgttctctgctgtggacatcggaatgacgggcgagaccaggcatggatcctgagcgtgatcacctggtcaccgcccgggcttcgacgctaggcgatcggcggacggcagcgaaacccccgaatccagacctgtggataactctcgcctgtggacaacggacacgggtgatccggatttcgctctaccatgagccgcgcaagtcgatcgatgcctgcacgatcggaaggaggcccgcgtgacgaccggcccggccaccgcaccacgcttctccgctgtgcgcctccaccaggtgatcgccacccaggcggccgtggtcctgctcctgatcggcgccgcggcgggtggcctcgtcctgatctcggccgctgccggcgccgccgccctgctcacgatgacctggctgcgcgtccgcggacgctgggcgttccagtggctcgccgccgactggcgtttccgcgcccgtcgccgtgccggcgccacgatgctcgagctcgccgcccccggcgcccaggtcacctcgatcgccctgccgcgaggccccgccgcggtgctcgccgacgagttcggcctgaccatgcttctcgagctcggcgatccggccggcccgctggccgagccccgctccggcctggccgccccctgggagctgctgcgcgacgcccagcagcgaccgccgagccggattcagctgttgctcaccgcagcgccggtgaccgccgggcccgggccggtcgccagctcgtaccggatgctcaccggcggcgccaccctcggatacacccggacggtgctcgcggtccgcgtgctgcgcaccgacggctggaccgagggcgagctgcgccaggccctgcggggccaggcacgcaagctcgccagccggctcagggcccggccgttgccccaggccgcggcggtccgggcgcttgccgatctgacgtacgccgatcccgcggccgaggtccaggagcagtggccggtgctgcgggccggcccactgtcccaggtgaccttccaggctcgcccccgggccgacgtggcaccgtccgccgggttgctcacccggctgctccagctcccggtcaccgccaccaccgtcacggtcaccgccgacctgccggagcccgagtcctccgagccgccacggatctccctgtcggtccgcctgaccgcacccgaccgggccgccctggagtccgcggcgcagaccctgacccggctggcgcgcgccgagcgcatcgagctccgccgccgcgacggcgagcacctgcacggcctcaccgccaccctgcccctggccctgcccggcgactccgccgtcctcaccggcgatcccctcgatctggccctgctcccggtccggcacagcgactctctccacccggcgcctgccgccccgggcacgacccaccacgccccggatccgacatcagccgccgccccgggcacgacccaccacgccccggatacggcatcggctgcaccgggcacgacccgtagcgccctcgcccccgcaccggtctcaccgagcacgaccggcttccgccgggatcccggcctccgcggcgagaaaccggcgccttccgccgacacggtgcagccggagcccttccggtccaggtcgccgagacgacggcgcggcctggtcgatccccgcctgaaaccgaccatgcggcgaggcgcggtcacccacccccggccctccgcgccgctccacccgcccgcgcccgagccatccgacggcgaatccgaaccgcggccctcgatcaccagcgagcagttcggcaggctgacgctgcccaccggaagctccggtgtcgccgtcggccaggatcggcacggcaaacccgtgctgatcccgctgttccggccggcgccgacccgggtgctggtcgtcggcggtttccgctgtgctcagctgctggccttccgcgcgatggcggtcggcgcccaggtactggtgcgcaccctgcggcccggcgactggaccgcgttcgctcgtgccaccgcctcgccgggcgtcgcaatcggcatcgtgccaccggacaggccggtcgacctgccgctcgcttccccgctgcgcccgatactgaccatcctggacgtggacccgcttcccgcgcccgggccacatcccggcggccacagccccggccccggccgcccgtctccgagtcccagtccacgccctagccctcgcccgagaccccagccggccgtcacccaccccgtcgtcgccacttcctcggtcaccaccccagcccccaccaccccagcgaccccgggcacagcaaccccagccacagccgcctccgccacagccacctcggtcacagccggcgtatacgcgctcggcacaggcgcccccggcgacggcggccacatcgcgacgaccggtgacgacccgccggggcgcgacaccgcggaccagaccgacgacgacaccgaccgatggctcgaatgcatgcaggacagtggcccctgggaggccaccctgatgctccggcgggagttcgccgcctcggacggccgcaccgcgaccgacgccgatctggtcctgttgcagccgttgcgggccgacgaggccgaacgggccggtgacgcgttgccgctcggggacgccgcgcgactgctcagccggatgcgctccgggatgatcgggatcgccggtccgcacggcatccgctgggcgatgctggctcccacggccatcgaaaaggtgctgatcggagacctgacccggaggaacatttgagcgatagagctcaatatgtcggaatatccggcggcggacggatgaagatcgcggagtgtcgtacccaccggtggcacggccgtggcaccatcccgtgccatgggcatcatcatccggctcgtgatcacggccgtctcgctgtggatctcgaccctggtcatcgacgggatcgacctcaccgcgaacaccgcgacgagtaaggcaggcaccctcctcgccgtcgcggtgatcttcggcgtggtgaacgcgatcctccggccgatcatcaagacgatcggctgcgggctctacgtcttcacgctcgggctgatcgcggtggtcgtcaacggcctgctgttcatgctgacgagctggatcgccggccagttcgacctgggcttccacgtcgaccacttctggccctcggcggtcctcggcgcgctgctcgtcggcatcgtgagctgggttctcaacatgctcgtccccgacggcggcgacgacaactgaccgccggcggccccaccccccggcggccgcgcacagcaggacctcacgagcgcgggatgccacacggcgtcccgcgctcgcgcgcacccaccccgttccgcgagcgcgggccaaagcccccggattggccctgtgaggtggaatatatgcaaggagcgcggcaccgttgcggccttacggtaagggcatgagcgacgagcggcgcggctatctgtacggcatcacggcgtacgtgctgtggggcttcttcccgatctacttcaagctgctcaagccgtccccgcccctggagatcctggcgcaccggatcatctggtcggtcgtgttcgtcgcgctgctgctcaccgcgatgcgcaactggtccttcctcggtcggatcctgcgcaccccacgcctgctcgggggcgtcaccgccgcggctttgctgatcggcgtgaactgggcgacctacatctacggcgtcaactcgtcccgggtcgtcgaggccgcgctcggctacttcatcacgccgctggtcgtggtcctgctcggcgtcaccgtccagcgcgaacgcctgcacccctggcagtggatcgcggtcggcatcggcggcctggcggtcgccatcctcaccgtcgactacggccgcctgccgtacatcgcgctgatcctggccgcgtcgttcggctcgtacagcctgatcaagaagcgcatgtcactcccgcccgccgagggcctgttcgtcgagtcagccgtcctcgcgctgcccgcgctcgcctacctgacctggctcaacctcggtcacggcgcgaagttcggccacgtctccggcgtacacaccgccctgatgctcttctccggcatcgccaccgccgtcccgctgctgctcttcgccggcgccgccaaccgcgttcccctcgtcggcctcggcatcctgcagtacatcgccccgatcctccagctggcctgcggcatcctgatctaccacgagccgatgccgcccgcccgcctcgccgggttcgccctggtctggttggccctgatcatcttcaccgcccacggcatccactcagcccgcaccaccgcccgccagcgagccaccacccgcgtctgaagcccacctatttggtacgccggaacctcaccccgccgggcacactgccctgccttgcagaaccgccccgttcagcacatccccgcgcgctgcgctgccccaccgcaccgcctacgtccgacccgccgctccggagacctggcagtcagccatggccgcggccgccggtcagccgagactgcggagcccgtagtcaggcgggactcggctgcgccgggatcagcggggacggtaggtgagcatgatcttgccgtcgaagcggaccaggtcgatgcggtcgagaccttcaatggtgaagtgggtgttggccagcatccggaattccgcgcccgggtgggccgtccacgagccgacctgttcgctctggtcgtcggggccgtaggcgatcaggccgaacgtgtaaggcttctccgactccgcgtaccggcacaccatctcgattttggtgccgccggccgtcccggtcagacggatgttggcggagatcggcgaggaattgttcacggcggccatcgcgaccgccggcccggaggcggcgctgcccggctcggcccggttcatcagccacagtgtcacgccgaccccgaggatcatgaccaggaggacggccgcggcggtgctcagcaggcgtaccggaaaggttctggccctgggcggcggagtcgcccggtgtgaccgttcggcggccggagcggcgaacggccgggcgggcggcgattggtcgagcagtgacgggtcgagcagccgcgcgaactcgtccgcgtcgagacggtccagcatgtccggcacacgggataaatcggccacggcctcccggcagaacgagcacgtcgccagatgctgctcgtaggccgcccgctctgccggcgacagcgcgccgaggacgtacgcggcgtcgtcgtgcccgtcctcacaccgcatctgtcccgcctccagccggctttcaagtcatccgcactctggtacgcgacaggcgccggggaggttcaaatatctcttaaacccgcacctcaagctgtagcgatccggtcacccgaaacttcctggtgcagggaaaacgcgtgaaatagccacctcgaaaatcccaccgcaaagatcgaaaccaacataccgcccggcggaaattcacaaacccgaacgacccccgaatccggcccggcaccggctgccgaggcgccgggacgtgacgggcgtcaggcggtggcggattcgcctccggagagggcttcggcgacgttgcgggcggcggcggtgagtttggcgcggaccacgcgggccgaggtgagcatttcggcggcgggcatggagcaggcgaggaccagacggcgttccatgtcccggtcggcgaccacgaccacggcggcggaggcgaggccctggcggaactggcccatctcgatctgcatgccgcggcgttcgccggccgccaggtcggcctccaacgcctccggggtggtcagcgtggtgggggtgaacgcccgcatcccgtagtcgcgcaggtatcgcccgcgctgatcgggggtgagcgtggcgagcagcgccttgcccagggcggtggcgtggccgccctcgtcgaagccgggggcgacgtcgtcgaggaacggggagcgggcgccctcggcggaggcggtgaccgcgatccgcccgccgacgaaacggcccaggtagtggctgtagccggtgtcgagagcggcacggcgcagggcgtcaccgacggccggcgggccgcggaaggccgacacgagctcccggtagcggtcggcgatctccaaaccgacgatgtacgtgccgtcctcgcggcggatcacgtagccctcgtaggcgagggtgcgcacgaggtgatacgtggtggcgacggtcagctcgcagcgacgggcgatctgtttcaccgtgagcccgcgcggagcccggccgaccgactccaggacgcgcagggcacgcgacacgctccggatgagatctgacggctccgctagcgggtcacgcacagctacctccgaggccagggacttacaccatatgaagaaacatccggcgacggaatgccaaaagcatgtggatcacgatcgatttgcacagcgggtgtgatcaatagaacgcggcgtgtccgaacgtgcccgaattgatccgatagcttctgccccaaatcgcccactaaaaccggcatccaccaggcaaaacgcctcccctccccaccggccgcccatatcatgcacatttctgtttcgacacccgtcttcctggctgtcgggttgcccgatcagcccgcccccaaccctccacccaggccccgcaccccgccgggccgtctacccggcctccacacctcagcaggccgtcatccccatcccaacccgtcgccgggccggcggtggccctggtgccgcacggcggcgtgcaggagatggcccggccgcgaacaggcggccgagagccctgtggagagtccgccccaccgcgggaagcattggcccgcgcggttgagcgtgtcaggcagccggtgtcctggacggcggcagagcgccttgaccgcaagcgtcccaggcgacggacgtcctgggcggcagggcgccttgggcagcaccgtggccagccgcatctcgggcggcagggcctcggagcgggatgcacgccactgatcgttatcggcctaaccgccgaacccgaaagctgcccgtcgaaccctgcgaatgatcaccatcccgaaatatggaccagaccgtcggccgacgtgctagacgccacccaggacaggaagacccacggcatggtttccgcgaccaacagcggatgtggaagggcgcggcgcttgtcctggacgggccagcggccctgatctcgcgtcaaacggtgattcagttggtgcggtcggccatgtagtcgcagagcagctccatcgcccgcttcgcctccccctcgggcagcggcgccagccgctcgcgagccgcctccgcatacccccgcaccgtctcccgcgcctgcttcatcgccgccgactcccgcagcagccccaacgcctcagcgtgcagcgcatcatcggtgatcggccccgcggagagcagctcccgcagccgcaccgcagccggatccgcgtcgtcccccgccagcgcgtagagcaccggcagggtcggcaccccttcccgcagatcggtccccggcgttttcccggactgcaccgactcggaggcgatgtccagcaggtcatcggagagctggaagaccagcccgatcagctccccgtacccggcgagcgcctcgaccagctcgggccgcgccccggagaacagcccgccgaagcgcgccgcagtggcgatcagcgacccggtcttgtcggcgatgacctgcagatagtgctgaatcgggtcggtgccccgcgggcccacggtttcggcgatctgcccgtgcaccagccgggagaaggtctgcgcctgcaggtggacggcctcggtgccgagtttggcggccagctcggcggcctgggcgaacaggtagtcgccgaccaggatggcgaccgagttgccccagcgcgcgttggcgctgggggtgccgcggcggaccggggcctcgtccatcacgtcgtcgtggtacagcgtggccaggtgggtcagctcgaccacgttggccgcgtcgatcagctcggggcgggccgggtcgccgaattgggcgccgagcgcgacgaggatcgggcggagtcgtttgccgccggcgtcggcgaggtggcgggccgcctcggtcaccagggggtcggcgctggcgacgcggacccgcagcgcttcctcgacggcggtcagcatcgccgacaccgacgcgtccatcgcgggatcgacgtcgaggcccagcgacgacagcgtcagctcaccggtgctcaccacggtcccacgatgccataccggcccaccggtttccgtcccaggggtgcgtgccacaagatcaggaatgagtgcggttgagatttgcccggatcgcccggtaggcgtcccacgaaatggatgggcgggccaggttccggcgttccggatggtggcgggtgatgacctgacattctcggccgctccggatccgccgcgggtgcggccgacgtcgatcaccgcgccggaatactcacggcggcgatcctgaaaggaccgcatcgccgaacgaccgcggccccggtgctggtgcaccggggccgcggggcgggaacggtcagcgaacaaactgggcggcatcccgcgtcaggtcgatcagcgcccccggcaccacgccgagcgccacggtgaccagcaccccgaggcccagtgcggccgaggtgaggaagcccgggatggagaccgacggggtgttctcgctcggctcggactgccacatcagcacgatcacccggacgtacgggaaggcgatcagcatgctgctgatcacgccgaagatgaccagccaggtctgcccgcccgcggtggccgccgcgaagaccgcgaacttggcggtgaagccactggtcagcgggatgccggcgaaggcgagcaggaccagggtgaagacgccggccagcagcggactcttgcggccgatgccggcccaccgggacaggtgggtggcctcgccgtcggcgtcccggaccaggctgacgatcgcgaacgcggcgatcaccgagaagccgtaggccaccaggtagaacatcgtgctgctcagcccgtcctcgttgagcgccaggacgccgaccatcaggtagccggcgttggcgatcgacgagtaggccagcagccgcttcatgtcggtctgggtgaccgccaggatcgcgccgatgaacatggtgagcaccgcgaccgccccgaggaccggctggaagtcccagcggacgccctcgaaggccacgtagaacacccggagcagggccccgaacgcggccaccttggtgcaggccgccatgaacgcggtgaccggggtcggagcgccctggtagacgtccggggtccagacgtggaacggggccagcgcgctcttgaagagcaggccgatcgcgaccagtccgagaccgccgtagaggagcagctggtcccgctgcgggctgaccaccgcctggtggatgacgctgagctggacgccgccggcgaagccgtacagtagcgcgacaccgaacaggaagaacgccgaggcgtacgacccgagcaggaagtacttgagggcggcctcctggctgagcaggcgccggcggcgggccagcgcgcacagcaggtacagcggcagcgagaagacctccagtgccacgaacatggtgagcaggtcgttcgcggcgacgaacagcagcatgccgccgagcgcgaaggtggccagcgggtacacctcggtgagcccgggctgcccggccgactgccggctgtccttatcggagccgaccacgaccgccgcctgggccacgaacgcaccgccggcctcgaccgaccgctcgccgatcaggaacagcgagaccgcgccgagcaacaggatcgcgccctgcaggaagacggtcggcccgtcgatcgcgaccgcgccgccgatcgtgacgagccggtcgttgcggtggatgaccaggacggtcagcgccgccgcgacacccagcagggccagcgacagctgcacgacgttgcgggaccgccgcggcaccagcacttcgaggagcaccccgaggcaggcgaccccgaagaggatcagcatgggggccagtgcgccgtagtcgatcggtgggagtttcatcggccagcctttccgtccgcgaccaccggggccgggtcctgcgtgccgacgtcgtgctgcagtgtcatctgcaccgccgggttgatcacgtcggtgaccggcttcgggtagaagccgagcaccagcaggagcacgatcagcggggcgaccacgaccttctcccgcagggtgaggtcgatccgcatgcccggcttctcctcgagggccgggttgagcgtgccctgggtggtccgctggatcatccagagcacgtacgccgcggccagcacgatgccggcggtggcgaccaccgcgtacgccttgtgcgtgctgaacgtgccgagcagcaccaggaattcgctgacgaacggcgccgtgccgggcagggccagtgaggccagaccggcgaagaacagcaccccggccagcaccgggaccagcttgccggccccgccgaagtcgctgaccagcgacgattcgcggcgggccacgaacatgccgaccacgatgaacagcaggccggtggccagaccgtggttgaccatgtacagcaccgagccggtgccaccctgggtggtgaaggcgaagatgccgatgccgatgaatccgaagtgcgcgatcgaggtgtatgacacgagccgcttcaggtcgttctgaccgaccgcgagcagggccgcgtagatgatcccgatcaccgcgatgaccagggcggccggcgcgaaccagcgggacgcctcggggaacagcgggaggcagtaccgcaggatgccgaacgtgccgaccttgtccatcacgccgaccagcagggcggccgcaccggccggggcggccgcaccggagtccggcagccaggtgtggaacgggaagaacggcgccttgatcgcgaacgccacgaagaagccgaggaacagccagcgggcggtgtccgtgttgatcgactgcgcggccttgacgagcgcctcgaagtcgaaggtgtgtccgccgttgacccacagcccgatcaccgcggccagcatgaacagaccgccgaccaggctgtagaggaagaacttcaccgcggcgtactgcttctggccggcgccgaacgagccgatgatgaagtacatcgggaccagcatgatctcgaagaacacgtagaacaggaagatgtccgccgcggcgaacaccccgatcatggtgaactcgaaggccagcagcagggcgaagtaggtcggcgcggaccgcttgctctggtccacgtcgttccaggacgccaggatgacgatcgggaacagcacggtcaccagcatcagcatcaccagggcgatgccgtccgcggcgaaggtgaagctggcgtgccaggacgggatccaggcgtacgactcgtggaactggaaccggtccttgctgtcgaccgtgtaacccacccacatgaagatgctgagtgcgagcaccaccagcgaggagatcagcgcgaccagcttggccagctcagccctggcccgcggaatgcaggccaccccgatcgccccgaccagcggcagcaacgtgaggattgacaggaacgggaaatctttcacgccagccaccccaactggatcgcgaggaaggcgcccaccaggagcatggcgccggtgagcatggacagggcgtacgagcggacgaagccggtctgcagccgccggagccggccggagccgccgcccaccgccgccgccagcccgttgaccaggccgtcgatgcccctgccgtccaggtagaccagcgcccgggtgaggtagatgccgggccgttcgaacaccgcctcgttgaacgcgtcggtgtacaggttgcgtcgggccgcggtgaccaccacccccgccggttccggtgccggctcggtgccgcggcggaaccgggcccaggccaggccggcgccgatcagcgtcagcaggatgctgagcagcgtgatccacagcttctcggtgtgctcgggctgctcgccgaagaccgggttgagccagtcgaccacggtcgtcgacatcacccagccggccaccaccgaaccgagcgccagcaggatcagcgggatcgtcatgatcgccggcgactcgtgcgggtgcgtgttctcctcggtgtagcgctgcggtccgtggaaggtgagcacgaacagccgggtcatgtagaaggcggtcaggcccgcgccgagcatcgccgcgccaccgaacagccagccggtccagccggggcggtcgaacgccgccgcgatgatcggctccttggtgaagaagccggacagcggcgggatgccgatgatcgccagccagcccatcatgaaggtgagccaggtggtcttcatgtatttgctgaggccgccgaaccgccggatgtcgacctggtcgtgcatgccgtgcatgaccgacccggccccgaggaacatgttcgccttgaagaagccgtgcgccagcaggtggatgatggccagcgcgtacgccgccccgccgagcccgacgccgaggaacatgtagccgatctggctgaccgtcgaccaggccagcacccgcttgatgtcgtccttggcggtgccgatgatgcagccgatcagcagcgtcagcgcacccacgctgaccaccaccagctgcagcgtgtcgttggccgagaagatcggattggaccgggcgatcaggtagacgcccgcggtgaccatggtggccgcgtggatcagggccgacaccggggtcgggccctccatcgcgtccggcagccaggcctgcagcgggaactggccggacttgccgcaggcgccgaggagcaggagcagacccatgatgagtacggtcgtcgaccccagcgagccgattctgccgaacaccgtggagtactgcgtgccgcccaccgtggtgaacatcaggaacacgccgatcgccaggccggcgtcaccgacccggttcatcaggaacgccttcttgccggcggtggccgccgacgggcgcgtgtaccagaaggagatcagcaggtaggacgccacaccgacaccctcccagccgaagtagagcatcacgtagttgttgccgaggacgagcagcagcatcgccgcgacgaacaggttgaagtagccgaagaagcggcgccgacccgggtcgtgctccatgtagccgaccgcgtacaggtggatcagcgatccgaccccggtgatcagcagcacgaacacgccggccagcgggtcgaagagcagaccgaagtcgaccttcaggctcccgacgtcgatgaagtcgaagaggctgagctccgcggaccgctgctcggcggcgagtccgccgagcttgatgaagaagatcaggccgagtacgaaggacgcggcgaccgcgagtacgccgagccagtgtccccaccggtcggcgcgtcgaccgagcagcagcaggatcgccgagctgaccagcgggatggccacgagcagccagatcccgctcagcacgcccgtcgcgggggcgtaggtgtgttccacgacagaccccttcagtacttcaggaggttcgcgtcgtcgacactcgccgagcgtcgcgtacggaagatcgacatgatgatggcgaggccgaccacgacctcggcggcggcgacgaccatcacgaagaacgagatgatctgaccgtccagcccgccgttgatccggctgaaggtgaccagcgccaggttcgccgcgttcagcatcagctcgatgcacatgaacaggacgatcgcgttgcgccgcaccagcacgccggcggccccgacggtgaacaggatgaccgccaggatcaggtagtagtcgggcgtcatttctcggttcccttcggggcgacctcggaagccgtcagctcccggaccggcaggatcggcgagatgctgttctccgtgccgttgccgtccggcaggcgggccggcgcggccaccgacatggtgttcgcgtagacgccggggcccggcttgggcccggggtagttgcccggccggaagcgctccttcatccgggtcacctggtcggccttgtcgcccttggccacctcgacgtgggccaggatcatcgccccgaccgccgccgtgatcagcagcgccgaggtgacctcgaaggcgaacacgtacctggtgaacagcagcgcggccaggccctgcacgttccccttctggttggcctggtccagacccacggtcggggtgtggttcagcgcccggcccagcccggtgccgaccagcagggcgaagcccaggccgagcaggatggcggcgacgcgctgcccgcgcagggtctcgatcagcgagtccgaggcgtcccggccgaccagcatcagcacgaacaggaacagcatcatgatcgcgccggtgtagacgatgatctgcacgaagcccaggaacggggcctggttgaccacgtacaggatgccgaggttcagcatcgtgacgaccaggcacagcgccgagtggaccgcgttgcgggccagcaccatgccgagcgccccgagcacggccagcgggccgaggatccagaaggcgatctgttccccggtggagacgtgtgtcattgctcgtccccccggtggagcggggccttctcggcaccggccgaggtgcccgggttggtcagcgcaccgacgtagtagtccttgtcggtctcgcccaggcgcatcgggtgcggcggctgctccatcccgggcagcagcggggccaggagttgttccttggtgaagatcaggtcctggcggctgtcccgggccagctcgtactcgttgctcatggtcagcgaacgggtcggacaggcctcgatgcagagcccgcagaagatgcaccgggtgtagttgatctggtagatcttcgcgaaccgctcacccggcgagaaccgctgctcgtcggtgttgtcgccaccctcgacgtagatcgcgtcggccgggcaggcccaggcgcacagctcgcagccgatgcacttctccagcccgtccggatgccggttgaggatgtgccggccgtggtaccgcggagccggcttcggtggggtgaacgggtagtcggtggtgaccaccttgcggaacatgtgcgcgaacgtgacaccgaagcccttgaaggagccggtaaacgtgttcacctcacacctccttcgactcggagtcgccgcccacggctgcgggggcgcgttcggcgaccgcgcggcgggcacgcgggctcgggggaacctgcaggtcgatcggcggaaccgggaagctgcccggtgggcggcgggccagttcctcctccagggagagctgccggggtttctccgccgacggccaggcgtaggcggccaccaggatgatcacgaccagcacgccgacggtgctgaacttgaccgtgtcggagatcaggccgtgccggatgaccttccagaacgccagcgcgaggatccacaccaggttgaccgggatcaggaccttccagccgaaccgcatgaactggtcgtagcgcatccggggcagcgtggcccgcagccagatgaagccgaacagcagcgtgaacaccttcaggaagaaccagagcagcgcccagtagccggagttcgccccgtgccagaccgcggtgatcggccacggcgcccgccagccgcccaggaacagcgtggtgcagaacgccgagacggtgatcatgttgatgtactcggccaggaagaacagcgcgaacttgaacgacgagtattccgtgtggaacccgccgaccagctcggactcggcctcgggcaggtcgaacggcgcccggttggtctcgccgaccgccgagatcatgtagaccaggaagctcggcagcagcagcacgcagtaccagccgggcgcggtgacgtgccagccgaacaggacgaccggctgacccgaggcctgcgccgcgacgatctgtgaggtgctcatcgtgcccgcggtcatgaacaccgcgacgatggacagacccatcgcgacctcgtacgagatcatctgcgcgcttgatcgcagaccacccagcagggggtacgtcgatccggaggcccagccggccagcaccacgccgtacacgctcatcgacgagcaggccagcagcaccagcaccgagaccggcacgtcggtgagctgcagcgcggtccggtgcccgaacatggtcaccacgccgccgaacgggatcaccgagaacgcggtgaacgccgtggtcgccgagatcaccggggcgatgaagtagaccaccttgtcggcggtcctggggatgatctcctccttgaacggcagcttcaggccgtcgctcagggaggtcagatagccgcggaaaccgacctggttggggccgggccggacagccatccgggccacgaccttgcgctcgtagttgatcgtgaacagggtcaggatcagcagcagggcgaacaggccgaccagtttgatcagcgcgatccaccagacgtcctgcccgaacgactcgggggccgggtccgtcgcgtgggccgcgaggagctcgatcatcggtcaactccctcggcgagaatcgggccgggcaggccggccgacagccggaccaccgcgccggcggtgacacccagactgcggcgcaccgtggaacccggcgagttggtcggcagccagaccacctgccggggcaggtcggcgatcgcggcgggcagggtcaccgagccgcggtcggtgcgtaccgtgagcaggtcgccgtccgcgacacgcagctgctcggccagctccttgccgagccgcacgaccggcggccgggcggtgccggccagcacgtcgtcgccgtccagcagcgtgcccaggtcgatcagctggtgccaggtggccagcaccgcggaccgctcaccggggtcggcgaccgcctcggcggccaccgacggcagcgcgggacgggcctgaccggccggcatcgcgcccagctcgcggcggaccgcctgcacgtccccggtgttcagggtgacgtcgagcagggcggcgatggcctccagcacccggccgtcggtcatcgccgtgctgccgcgcaggaccgtgccgaaggaccgtagccggccctcccagtccatgtaggtgccggacttctccaccgccggcgcgaccggcagcaccacgtcggcccgcgcggtcaccgcgctgtgccgcagctccaggctgaccaggaacggcaccgcgtccagcgcccgctcggcgagggccgggtcggtcaggtcgcccgggtccaccgcgccgaccagcaggccgccgagcgtcccgtcggccgccgccgcgatgatcgcgtcgacgtcccggccgggccgggacggcagcacaccggcgtccaccgaccaggagagggagagctcggcccgggacgacgtgtccccgaccgggcggccgccgggcagcaggttcggcaggcagccggcgtccaccgcaccccggtcaccggcccggcgcggcacccacgcgaggcgggcgccggttcgggcggccagcgcagcggccgccgagagcccgcccggcacggtggccagacgctcaccgaccagcagcaggctgcccggcgcgctgagcgccgcggccaccgtgggatcggtgttcagcagccgggcctcgtcacccgggaccgccgcgacgagcgtggcgccgagcttctcgaaaccccgggtcaggtgcggggccaccgcggtcacccgcaactgcctgcgggacgccttgcgcaggcgcaggaagaggatcgggcactcctcctccggctccagcccgacgatcaggatgctcggggcggcttcgacatcggcgtacgacagatcggaaaccccggcgaccgcggccgcgaggaagtccgcctcctcggtgatctcggccggcgagccggaggctcgcaccggccgggcccggaagtcgatgtcgttggtacccaggacgatccgggcgaatttcgcgtacgcgtacgcgtcctccaccgtgagccggcccccggtcagcaccccgacaccccgctcacgggccgccttgagcccctcggcggcggtgaccagcgcctcgctccaggacgcctcgcgcagctgcccggtgcgcgcgtcccggatcagcggcgtggtgatccggtcggtggccgtggcgtaacggaatccccaccgacccttgtcgcagttccactcctcgttgaccgccgggtcgtcaccggccagccggcgcagcaccttcccgcgccggtggtcggcccgcatcgagcagccggccgcgcagtgctcgcacgcggtgggcgaggagaccaggtcgaacggccgggcacggaaccggtactgctcgccggtcagcgcgcccaccgggcagatctggatggtgttgccggagaagtaggagttgaacgcgacgtcccccgccccctcgccgacctggccgtcaccggtacccgcgccaccgaagaagtcgtcgcggtacacgttgatctgctcgccggaggagcggtccatcaggtcgatgaacttgtcgccggcgatctcctcggagaaccgggtgcagcgctggcagagcacgcagcgttcccggtccagcaggacctggctggagatgtggatcggcttctcgtactcccgcttgtgctcgtggaaccgggagtcggcgcggccggtgctcatcgcctggttctgcagcgggcactcgccacccttgtcgcaggtggggcagtcgagcgggtggttgatcagcagcagctccatcacgccggcctgggccttggccgcgaccggcgagctgagctgggtcttgaccaccatgccgtcggccaccgtctgggtgcacgaggcgatcggcttgcgctggccctccacctcgaccaggcactggcggcaggcgccggccggggccagcagcgggtgatcgcagaaccgcgggatcgcgatgcccatccgctcggcgacccggatcagcagctcgcccttctcggcgaccacctcgacgccgtcgatggtcagcttgacggtgtcggctctcttggctacgtcggtcatcagtgcgctcctacgagggacttctcggagagccgcggcgcggtgcggccctcgatgtagccgaggtagtcgtcccggaaccacttcagcgtcgagacgaccggcgtcgcggcgccgtcgccgaggccgcagaaggaccggccgaagatgttgtccgcggtgtcctgcagcgtgtccaggtcggcataggtgccctgaccggccaggatccgccggtaggtgcgcaccatccagtagttgccctcccggcacggggtgcacttgccgcacgactcgtggtggtagaactccagccaccgccacgtgttgtagaccgggcagtcctggtcggagaagatctgcatcgccgtggtgcccaggatcgagccggccgccgcgaccccctcgaagtccatcggggtgtcgatgtgctcggcggtcaggatcggcgtggacgagccgcccggggtccagaacttcagctcgtgccccggctgcatgcccccggccagctcgatcagctcgcgcagggtgatgccgaggccgcactcgtactgtccgggattgaccacccggccggagagcgagtagatcatcgggccggccgacttctcggtgcccatgctcttccaccagtcggcgccgcccagcacgatgtacggcacgctcgcgatcgtcccgacgttgttgaccaccgtggggctggcgtacaggccggcgatcgccgggaacggcgggcgcagccgaggctgaccgcggaagccctccagcgagtcgagcagcgcggtctcctcgccgcagatgtacgcgccggccccgctgtgcaccaccaggtccaggtcgtacccggaaccgaggatgtcggtgcccaggtagccggcggcgtacgcctcccggaccgcgttgcgcagccgccgcgcggcgtgcaccgcctcaccgcggatgtagatgaacgcccggttcgcccggatggcgtaggacgcgatgatcgcgccctccaccagcgagtgcgggtcgtaggtcatcagtggcaggtccttgcaggtgcccggctcgccctcgtccgcgttgatcacgaggtagtgcggcttgccgtcgccctgtgggatgaagccccacttgaggccggtggggaagccggccccgccgcggccgcgcaggccggagtccttgatcagctggatcacgtcgtccgggtgcacgtcgagcgccttgcgcaccgcctggtagccgtcgagccgctcgtagacgccgatctgccaggcgtccggcgagagccagcgcttggtgagcaccggggtgagcttctggagcacctccggccggggttgcgtcacttctcctcctcggtgccacgggtcgggtcgggcgtacgcgggctgtcccccgccggtttgccgtcaccggccggcgcgttggccgcggcgccggccgtctcggcggcgttctccggcggcgggccgccggccgaggccgcggcaccggccggttcgctcgcggtgggattgcgcagtgccgcggtacggacctgtggatcctcggtcgtgtgaccggcgtgccggcgctcctcgacctttccggcgaccgctttcaccgcggtcgtcgccgcgtgcaccaccgaggcgacccggccgggtttttccgcctttccgtccggcgccggcttcggctgcgcgtcgccctcccgggccggtttggtccgggtgatcggggtctccgggtcgaacccggccaccgcgatcccgtgctcctgcgccaagcgcaccccgcgcagcgtgggcgcgccggccaccccgtcgccgaccgcgccgtcccgggggtcggcgaagccggcgagctggtactgcatctcgcgcagcgagcagatccgcgcgccgcgggacggcgtgggccgctcgccgttgcgcaggctgtcgaccaactccaccgcggagtccggggtggcctggtcgacggtgaagtcgtagttgaccgtcaccaccggggcgtagtcgcaggccgccaggcattcggcgtgctccagcgtgatccggccgtcagcggtggtctcgtcgtggccgaccccgaggtgctcggtcagccggtcgtagaccgcctggccgcccagcacgttgcacagggtgttggtgcagacgctgaccaggtattcgccggtggggcggcgcttgtacatggtgtagaaggtggcgaccgcgccgacctgggccttgttgatgcccagcacctcggcgcagaaggccaccccggccgggctgacgtggccctcctcggtctgcaccaggtgcagcagcggcagcagcgccgagcgctcccggccggccggataccgcgccaggatctcctgcgcggacccgagcagcttctccgcgagcggagccgcagccggggtgaattcaacctgcttctcacttgcttctgtgttgcggcgaagccgcccggcaagctcggtcatcagcgatcacacccacccatcacggggtccagcgacgcgccgccggcgatcacgtcggcgagcagcgcgccctcggccatcgccgggatggcctggaggttgacgaagctcggctcgcggtagtgcacccggtagggatgggtgccaccgtcggaaaccgcgtgaacgccgagttcgccacgcggatgctcgaccgccacgtagacttggccgggcgggacccggaagccttcggtcacgagcttgaagtggtggatcagcgactccatcgactggcccatgatcttggcgacgtgttccagggagttgccgagaccgtccacccccagcgcgagctgggacggccaggcgatcttcttgtccgcgacccagatgggcccgggcttgagccggtcgagcgcctgctcgacgatcttgagcgactccttgatctcggcgagtcgcacgaggtatcggccccagacgtcgccggtggtcgcggtcggcacgtcgaactcgtacgtttcgtaaccgcagtagggcatcgtcttgcgcaggtcccagggcaggcccgcggagcgcagcaccggcccggtgatgcccagcgccaggcagccggtcacgtccaggacggcgaccccctgcgtgcgcttctgccagatcacctggccggagagcatcgcctcgtactccttgagcttcttcggcaggtacacgaggaagtcacggatcttcttgaccgccgagtcgggcaggtcctggctcaggccgccggggcggatgtagccgttgttcatccgcaggccggaggtctcctcgaagatgtcgaggatgtactcccgctcgcggaagccgtacagcatcatcgagatcgcgcccagttccatgccggtggtggccagccagaccaggtgcgaggcgatccgctgcagctccatgaagagcacccggatcgtggtggcccgctcggtgatctggtcggtgatgccgagcagcttctccaccgcgaggcagtacgccgcctcgttcgacatgttggacaggtagtccatccgcgtgacgaacgtgacgccctgggtccaggtccggtactccaggttcttctcgatcccggtgtgcaggtagccgatcaccgggcgggcctcggtcaccgtctcgccctcaagctccagcaccagccggagcaccccgtgcgtggacgggtgctgggggcccatgttgacgacgatcttctcgttgctgagcgggtcgatgccgctggtcacgctgtcccagtcgccgccggtgaccgtgaagacccggccctcggtggtctcgcgcgcgctcgcgtattccgacgttgtcactggtagaccctccgctggtcgggcggcgggatctcggcgcccttgtattccacgggcaccccgccgagcgggtagtccttgcgctgggggtggccctcccagtcgtccggcatcaggatccgggtgaggttggggtggccggcgaagacgacgccgaacatgtcgtagacctcccgctcctgccagtccgcggtcgggtagatgccggtgacgctcgggaccggcacgccgtcggcgacggacacctcgagacggaccctccggcggtacgtcatcgaggtcagttgataggcgatgtggaatcgccgctcgtcgctgcccaggtagtcgaccgcatcgaccgaggagcacagctcgaaccgcagggagtcgtcgtcccgcattacctgacagacatccgtgattctctcggccctgatgtgaagtgtgagctccgccctatccacgaccactttctcgatggcttcggagaaggccggataagcttcctccaacgcgtcatagacgtcgtcgaaatacccgccgtatggccgtgggctgtcaaaaacagcaggccgggggcggaccaggcggccgaaaccggagacgtcgccggtgcctttgacgccgaacatgcccttatccgggctgggcggtgtctgggcgggtgcgtcgagattcgcgccggtcgttgcggtgacgggaacgttaccgtcagttcctggttgaatactcatttgccctcccgcaaatgcggctggagtttcatccagttctcgatccgcaattgctcctcgcggccttccttgacggcctgcgtccattccgcgcgacgcgccttgtcgacgcggtacgacgacggcatggcgccgggcgcgacgagcggcagcttgccctcggcacgacgttgctccagcatcttccggccgttcgggccgagaggctgggccatcaccttctcgcgcatcttgaggatcgcgtcgatcagcatctccggccgcggcgggcagcccggcaggtagatgtcgaccgggacgatgtggtccacgccctggacgatcgcgtagttgttgaacatgccgccggacgaggcgcagacgcccatcgagatcaccgaacggggttccggcatctggtcgtagatctggcggaccaccggggccatcttctgactgacccgacccgcgacgatcatcaggtcggcctggcgaggcgaggcgcggaacacctccatgccccagcgacccaggtcgtagtgcgggccgccggccgccatcatctcgatggcgcaacaggcgagtccgaaggtcgcgccccagaacgacgacttgcgggcccagttcgacagcttctcgaccgaggtgaggaggatgccactgggcagcttctcttcgattcccatggttatcagtcccagttgaggccgccgcgtcgccacacgtacgtgtaggcgatgaacacggtgacgatgaacaggaccatttccacgaatccgaacaggcccagcgcctcgaacgagacggcccacgggtacaggaagatggtctcgatgtcgaagacgatgaagagcatcgccgtcagatagaacttcaccgggaatcggccgccgccgaccggttgtggggccggctcgatgccgcactcgtaggcgtccatttttgcccggttgtagcgcttcggcccgacgatcggtgccacagacaccgagaacaacgcgaagagcgcgccgaggatcagcaacccgacgatcgggacgtatgggttgatcgtcatcttcactcccgtacgactgttagccgcttcacactagtttttcgcttttgtatccctctggtcggggtgcccgattccgtcgtcagacggcgggcgccaccttcgtcaagccgttgatgatgcggtccatggcgtcgccaccgcgcggatcggtcagattcgccaggagcttgagaacgaacctcatcaacgtcgggtgcggcatgccgtgcttcgtggccagccgcatgacctgcggattcccgatgagcttcacgaacacaccgccgagccggtagtaaccgccgaagcgcaggctcaactcggtcgggtaggcgcgcagggcgcgctcgcgctccggaccggccggacgggccaacgcctgcgcggccacctcggcggccagctcgccggactccatcgcgtacgcgatgccctcgccgttcatcgggttgaccatgccacccgaatcgccgacgagcagtaccccgcgggtgtaatgcggcacccggttgaagcccatcgggagcgcggcgcccagcgtcgggccctctgcgttctcctcgccgcgcagcccccactcctggggagtggagccgagccagtcggtgagcatgttcttgtagttggtcctgccgaaggcgctcgacgagttgaggatgcccaggccggcgttgacccggccgtcacccaggccgaagatccagccgtaaccggggagcagccggctcggatcctgcgcgctgcgcagctccagccaggactccaggtagttgtcgtcggccttgaccgcggagcggtagtagcgccggacagccacccccagcgggcggtcgtcgcgcttggccaggcccatggccagcggaaacttgccggagacgccgtccgcggcgatcaccaggggagcgcggaactgcaccggctctttctccggaccgaccttggcctggacgccgatcacgtaaccttcgtcattgaggaccggaccaccgacgttcacgttcgtgcgcagcagcgcgccggcttccaccgcgcgctcggccagcatgtcgtcgaagtccagacgggtgcggaccaggccgtaactggggaaactggccagctcgggccagtccagctccagccggaccccgccgccgatcacccgcaggccgcgattctgcagccagcccgccttctccgaggtgtcgatgcccatccggaccagctggcggacggcgcgcggggtcagcccgtcgccacacaccttctcgcgcgggaactcggtcttctccagcagcagcacccggtgcccgtgccgggccaggtggtaagccgccgcgctgccaccgggacccgcaccgaccacgatcacgtcggcttcgccggcgacgggcaggggttcgttcacggtgcagcctccgatccgcagtgctcgtgaattagttcacaagcatgcctcggtcggagtctaggccgactatcgacgatctttacacccaggtcgacctgattgttgtggcgagctcactggatcgggtcagaatcacccaaaacgcgctccgcgatcccacgtgccggaccctcgagatgatctcgaatggtgccgtccatcgcccggtccagagcgacgatcaattcctctaccaggtcttgcgccaacagcggatcctgggcggcgaccatccggatgcggttcgcgagctcgctggcccggcgctcgccggcctcgccctcgtcgatcgcgatgtcgatgtcggtgtcctctagctgccctagtttcgtcatgacatcgagctaaacagtggatacggaccgtgtacgcgaaacgcccgatttgtcaccgacacgcgcgggatgatcatttccgccgcagcgcgcgctgcgttcgcaccacgcggctgccaccatcccgcggccgcgacccacctccgggtcccacttcgccccgcggcgcgccccaccttgcggcccgttcggcgcgtcacgcgccgctttcccccggtccggcgaatcggcggtacggcgtgggtcagcgccgaatcgcccggtgcagcgccacgaccccgccggtgagattccgccagcccacgcgatcccacggtcccgcctcggcgatccgcgtcgccaaccccgcctggtcgggccaggcccggatcgactcggccagatagacataggcgtcggggttgctggacaccccgcgcgcgacgaccggcagcgaccgcatcagatactgcatgtaaaccgtccggaatgccggattcgtcggggtgctgaactcgcacaccaccagccgcccgcccggccgcgtcacccggccgaactcacgcaacgcagcaccggtgtccaccacgttgcgtaacgcgaaggagatcgtcaccgcgtcgaaggtggcatcggcgaacggcagcttcagcgcatccccggccagcagcggcaccaccggccgcaccgcccgcccggcctgcagcatccccaccgacaggtcggcacccaccgcgaacgccccggaccgccccagctcgtcggtggagatcccggtgccggcgcccacgtccagcacccgctcacccggccgcagcccgagggccgcccgggtggcccggcgccagccccggtcctgcccgaaggagagcacggtgttggtgaggtcataccgtttggccacgccgtcgaacatctcggcgacctcgtgcggctgcttgtccaggtctgcgcgcgtcacccggcccactctgccactctctccgccacccaccccacgcgggccgacagcctgcccccgccgcccacagcgcccgagcccatccaccgccgctttcatcgccgcatgcgtgcccaccgccgctttcatcgccgcatgcgtgcccaccgccgcttaagcggctgcttgcgtgcccaccgccgttttcaccgccggatgcgtgcccaccgccgtgatcccgggcggacgcgctcaccgccctcgccgcgacctgggggctctcgccatgatcgcgagcatgcaggcccaccgcttctgccacggcttggcggctcatcgcgtacgcccgagtcggctttgacggtcgggaccggctgaccgcgccgcgctcagccggccgcccggacccgccgcgggccggaaacagaacaggcgggatggtttcccatcccgcccgcaccttgtgcgttatatatacgaccgccatcggtcgggtccgactgctcgtcaccgacgctttccgcctggcgacgcatgaggttttgccaatgccttacgcaggcaacgtaaccagcgggaacggcgcggtacagccaacaggcgggctcgttacgaaggagcaatccagccctcaccggtccgacgacccccaccctggccgaacggtcaggcgcgacccaccgaaggggccggtccgcgctcgtcggacaagatctttccgcaggccggacggtgtttcccgataacgatccggtagcggtcggcgggctagttgacctcgacaagcggcaacggggtgcgcccggcgcccccgcccggcatcgcgatcgacgagaagtgcgacaccacccggtcgtcggtcggatcctcggccgccgtgtggtggaccgcgaggtgccgataccacgtgtcgcgccaggccggaatgcggtcggcggtgcggatcatcgagatcagctcctgcaggttcgaccgatgccgggcgccggccgaggagatcacgttctcctccagcatgatcgagcccaggtcgtcgacgcccatgtgtagcgacagctggccgatgtccttgccggtggtcagccaggaggcctgcaggtgcgccacgttgtcgaagaacagccgggagaccgcgatgaaccgcaggtattccatcgtggtggcctgggtgcggcccttgagatggttgttctccggctggtaggtccacgggatgaaggcccggaagccaccgacgtcgtgcgactcctcgaccggcacgtcccggtacccgttggccacggccagatcctgcacgtcgcggatcatccggatgtgctcgatccgctcggcgttggtctcgccggtgcccatcatcatggtcgcggtggaggacagcccgttacggtgcgccaccgccatcacctcgagccagcgcgctccgctctccttcagcggggcgatcgcctggcgcggccggtcgggcagcatctcggcgccggcgccggcgatcgagtccagcccggccgccttgatccggacgatcgcgtcctcgatcgagacctgcgagaccttggccatgtgcaggatctcactcgggccgatcgagtggatcgccagctgcgggaacgcctgcttgaccgaggagaacagctcctcgtagtactccacgccgtagtccgggtggtggccgccctgcagcatcacctgggtggcgccgagctccaccgcctcaccgcaccggcgcaggatctcctcggtcgggtgcgaccagccctctttgtgcttgggcgcccggaagaacgcgcagaacttgcacgccgtgacacagacgttggtgtagttgatgttgcgatcgatcaggtacgtgacgatgccgtccgggtagcgccggcggcggaccgtgtcggccgcctcgcccagcgcgtggaacggggcctccgtgtagagcagcagggcctcctcggggctgatccgcccaccgtcggcgccgcgctgcaggatgctgtcgatctcccgattcgccgtcacgagaggaagcgtacgtcccccctccgacaatcgtcagcggcccgggtcaccggcgggctcgccgtcgatcagcgcggccaggccgtcgaggacccggcgcagaccgaactcgtacgcgtgatccgggtcgtaggccgcgcccagagccgcgccggccgcggcgcccacccgggccgcggtggggtaggtgtgctcgtcgaggaccacctgcagggccggcccgcgctcctgccaccactcccagtcggtctggtgggcgcgctcggcggtggcccgcacctcggcggcggccctcgccgcggcctgcacgaagcccagcaggaaggtgagcgccgagtcgaccgtcacgtcgtccagcccacagccgtcgaaggcgcgcagctcatgctcgtacttggccatcaggccggggcccagcggcggccggctggccggcatcgcggccacccagggatgcgcggcgaccagcgcccggttctcctcggcgatcgcggccgcccggtcgcgccacgaccggccgggcagctcggcgcggggcatcgcgagatagacccggtccagcatcagctccagcagggtcgccttgtccgggacgtaggtgtacagcgtcatcggcaccacacccagctcggtggcgacgcggcgcatcgacacgccctccaggccctcggcgtcggccagcgcgatgccggtctcgaccacccgggccacgctcagcccggggcggcggcctcgcttgcgctcgaccgcctccggaaaccagagcaggtccatggtgcggcgcgcttcagccatcggggtggcactccattcttgtacggcgtattgtgtacggcgtacagctaaacgccctggggaggcagccatgcgagtcaggtccaccgccattgcgctcaccgtcgacgatgtccccacctcgaccaagtttctcgcggatcacttcggctacaccgaacggatggccgccgacggattcgcctccctcgggcgcgaccacaccgggcccgacctgatcttcatgcgccgcggcctggaggtgctgccgcccaccctgcgcgatgtgcacacggccggcacgatcgtcgcgttcgtggtcgacgacctggacgccgagcaggacaggttgcgcgctgagggggtggagcctttcctgccgatccgggaggagccgtggggcgagcggctgctgttggtcagcgacccgaacggggtcgtttacgagctggtggagtgggccgatcccgggtccggccgataatctcgacggactgctcagggggttgatgtgctcgtcgttcacggcggctgggcgcccgggtccgggcggcccggtcggttgctgctctgggctgaggagccgtcccgtacggagtcctcctcagcgtcccgtgccaaggtgcggccccacccgttcgccgccacggccaccgtcctgaccacggccctgggcgacctgccgtccgagcccaccgccgggatcgccacgatccagctgcccggcacggcccgcggtccgctgccctcgccggacaccggggtggagacgacctcgccgcggggtgtccggctggccgggtggaccgtgccggtgctcgccgtgcccggtgaggccgccctggccgtgctggccacgatcgccgagccggacccggccgcgccgtgggttcccggcccctccctgcgctatctcggcctcctcgccggctgggcctgcgacctggcccggcacggccggatgctcccgcagctcgtcctggaggagggcgtgccggccgcccggtggcgctccgtgatcaccggtgccgacctcgcgacgtaccgtgacttcgccgccgggatgccgccggtggcccgcgccgtgacgccggccggtcaggccgtgacgccggccggccagcaggccgggcggacgctgcgggacgcgctggagacgatgctcgacgccgccgcgcggtccgtcctgccggaaaagatcctgggcggccaccgggccgggctccgggctccgctggccgaccggtgggtgaccgcgctcaccgcgcccgaccccacactccccggtgcggccgcggccgagctgcgtgagctgcgccgggcgctggacgactggatgcgcgcggcccaggcggcgaatgagccggtccgggtcagtttccgactgatcgagcccgagccgggcgaggacgactgggagctggaattcgccctgcagtccgccgaggactccgcgctctacctgcccgccgaggcggtctgggccggcgagcggtttcccgggctgcctcgccggccggatgagacactgctggccgggctgggtcgggcggtccggttgttcccggcgctgcacgaggcgctgcgcacccagcagccggccgccatgacgctcgacaccgccgaggcatatgacttcctccgccaggccgcgccgctgctgcaggccgccggcttcggggtgcagctgccgtcctgggccggccgcaagggtgtcggcctcaagctgaccacccggtcgaaatccagagccggtacctcccgggcggtggccgactccggcttcgggctcagcgagatcgtcgccttccggctcgacctggtgatcggggacggcgtggtgagcgccgcggagctggccgagctggcccggctcaaggtgcccctggtccgggtccgcggacagtgggtggagctggacgaccggcagctcaaggcggcgctcaaggcggtcggccggcgacgcgagggcgagctgaccgccgccgagatcctgcagcaggtggttgagggcggcgaggaggatctgccgctcgtcgaggtcgacgccgacggcacgctcggcgacctgctgtccggccaggcctcggagcggctcgacccgatgccgaccccgccgggtttccagggcgcgctccgaccgtatcaggagcgtggcctctcctggctgcacttcctgagccggctcgggctgggcgggatcctcgccgacgacatgggcctgggcaagaccgcgcagacactgtcgctgctgctcaccggccaggcggacgagacgcgcccggcagagaggacgttgctgatctgccccatgtcgctgatcaccaactggcgcaaggaggccgctcggttcgccccgagcctgcgcgtctacgtgcaccacggcgccacccggcagcgcggcgaggacttccgggccgcggtggacgcggccgacctggtgctcaccacctacggcaccgcggcgcgcgacctggaggcgctccgcgaggtcgagtggagccgggtggcctgcgacgaggctcaggcgatcaaaaaccacggcacccgccagtcgcaggcggtccgcgccatcccggcgcgcacgcggctcgccctgaccggcaccccggtggaaaaccacctggccgagctctggtccatcatggacttctgcaatccggggctgctcggtccggcgaaacggttccgccgccggttccaggagccgatcgaaatcaaccagagcgaggacgcgaccgccgcactgaaacgggccaccgggccgttcgtgctgcgccgcctcaaaaccgacaagacgatcatctccgacctcccggagaagaacgagatgaaggtctggtgctcgctcaccgccgagcaggccaccctctaccaggccgtggtcgaggacatgatgtccgagatcgagggcagcgagggcatccagcggcggggcaacgtgctggccgcgatgatgaagctcaagcaggtctgcaaccatccggcgcacctgctcaaggacggctcccggttgcccgaccggtccggcaagctggcccgactggaggagctggccgaggagatcgtcgaggacggcgacaaggccctggtcttcacgcagtatgcggagtggggctcgctgctgcagccctacctggcggcgcacctggaccgcccggtgctgtggctgcacggcgggctcagcaagtcccgccgggacgagctggtcgagcggttccagacgtcgccggagccgatgctcttcctgctctcgctcaaggcggccggcaccggtctcaacctgaccgccgccaaccacgtcgtccacttcgaccggtggtggaacccggccgtcgaggatcaggccaccgaccgggcgttccgcatcggacagtcgcgcgacgtgcaggtgcgcaagttcatctgcaccggcaccctggaggagaagatcgacgcgatgatcgagcggaagaaggcgctggcctcggcggtcgtgggcaccggcgaggagtggatcaccgacctgagcaccgaccagttgcgcgagctgttcgccctcgaccccggggtggtgggctgaggtgcggcgggtggacgcgaccgggtgcgatcggccggggttcgaccgagaggcggtgggctgacgtgccgttcgacagatccggcaagttctacgaggcggcgcggccgatcgaggtcgacggcgggctcgcggtccggtcgaaacgcggcgcgatcggcgagcagtggtggtcgcggcggttcgtcgacgtgctggaggggatctgcgatccgggtcggctcgcccgcggtcgggcgtacgcacgcaaggggcaggtgatcgacttcgcgctgcagccgggacagctggtcgcgcgggtgcagggatcccggcccacgccctaccaggtgacgatccggatcagcgcgttcgacgacgcccagtgggcggagatcaccgaggcgctcggcgcgcaggcgctgtaccgtgccgcgctgctggccggcgagatgccgcgggagatcgtcgagctcttcaccgacctgggtttcccgctcttcccggagtcgttggacatcgactgctcctgccccgactggggcgttccgtgcaagcacggctcggccgcgctgtacgtgctggccgaggccttcgacgacgatccgttcctggtcctggcctggcgcgggcgggcccgggagccgctgctcgacgcactgcgcggcaccgccgacccgggtgaggcgatcgacccgctgcaggtcaccgaaaccccgctggacgaccggctcgccgacttctactcccccgggatcagcctgggccggctccgggagcggccggcccgcggtggcgccccgccggagctgctgcttcgcgccctcgatccgccgccgatccgggtccgacacattccgctgatcgacctgctgcgcccgctctaccgcgagttgggcacgccgcatgaggaggaggattagccatcctcggccgtctccggccgcggaaggggcctcgccgcctccggccgcggaaggggcctcaccgcctccggccgcggaaggagcggaccggtagcgtccgcggacgcggcattgccgggcggcgtccggtgtgaaccggccgcggtcggggcttcgagggccgcgtccagcgtggaccgatcgtgggcgagtccacgatggacgcggcggctcggagactacccgattgcctgtcggacagtgcccataagcatgcgaggcgtgacaacccgtgtcaatagacaatgaccgatatatgggtcttcctgggacgtcaccacgccgcgggctagggtcggatcatgactgagatgagctaccgccgcctcggcgaatccggcctcgtcgtctccgttgtcgggatcggctgcaacaatttcggccgcaaactcgacgcggacggcacccgggaggtcgtcgacgcggccttcgacgccggcatcacgctcttcgacacggcggacatctacggcaccccgcacggtagctcggaggaactgctcggcgccgccctcaagggccgccgggacgaagtcgtgctggccaccaagttcggcatggacatggcggggctgaacgggcgggacttcggcgctcgcggctcccggcgctacatcgtccgcgcggtcgaggcgtcactgcgccggctggaaaccgactacatcgacctctaccagctgcacgagcccgacccggccaccccgatcgaggagaccctgtccgctctcgacgacctggtccgcgccggcaaggtgcgatacctgggcaattccaacttctccggctggcagatcgcggacgccgactggaccgcccgggccgcggacctgaccccgttcatcagcgcacagaaccgctacagcctgctgcaccgggacgtggagatcgaggtggtcccggcgtgtgagcgtttcggcctgggcctgctgccgttcttcccgctcgactccggcctgctctccggcaagtatcggcggggcgagaagccggccgccggcacccggctcgcccaggaccgttacgcgccctggctggagcacgccgactggaaccggatcgacgcgctcaccgccttcggcgccgagcggggccacagtctgctggaggtggcgatcgccggcctggccgcccgccccgcggtgaccagcgtgatcgccggcgcgaccacccccgaccaggtgcacgcgaacgccgcggccgccgcctgggacctgaccgcggccgacgtggccaccctcgacgagatcctcaccgactgagccgccgccgaaggacaacacaacgacgcgaagcagcgccgggccgtcctggtccgacacggtccggcgcaggcgggcgggtgtccggtcagacgtcggcgaaacgacgcgaagcagcgccgggccgtcctggtccgacacggtccggcgcaggcgggcgggtgtccggtcagacgtcggcgaaaagcgggccctcggccggcagcgccggcacgtcgccgcggtcggcggcgcggcgggcgaactcgcggacgccctgaatctgccggtcacccagggagaagtcgagggcccggaagtagttggccagggtcgccgcgtcgaacggctcccagcgcgcggccgcctcggccaccgcgtccagctcgccgaggcacagctccttggaccgctggaacgcctcgtgcacgcccttgacctggccggggtgtgcggccgcgaaatccttccggaccgcccacacggcgaagaccatcggcagcccggtccattccttccacgcctcggccaggtcgatcacctgcaggcccatggccggcgcttcgtacagcgcgcgcagggcggggtcgccgatcagggccgcggcgtccgcttcccgcaacatcagaggcaggtcgggcgggcagcggaagtacgtgggctccaccccgtaccgctcggaaagcagcaattgcgccagcaggacgccggtccgcgaggtggaaccgagagcgaccggccgtttgtcgagctcggccggaggccgggtcgagaccaggttgaccgagagcaccgggccgtcgctgccgaccgcgaggtcgggcagcagcagcagctgatcggcgtgcttcaggtattcgaccagcgtgatcgggccgatgtcgaggtcgccggcgatcagggcggcgctgagccggtccggcgtgtccttgtgcaggtcgacgtcgagcagcgcgccggagcgcatcagaccccagtagatcgggaggcagttgaggaactggatgtgcccgacccggggccgacggacgctgtcgctcatgaggtgacggtatccccgaccacgacgggttcgcccagcgacggggcctctcgtggctgaagtcgcaccagcggccagcagcagagcgcggcgagcagcccggccccgccggccgccccgaccagcagccgcgggtcgaaggcctccaccagcggcccggcgaccaggaagccgagcagtccggcgccctgcacgaccgcggcgaccccggcgaacgcgcgaccgtgcgccgcggccggcacccggtccgcgatgatcaccgtcatacagacgttgagcgcgccgttgcacaccccgccgacgatccagagcggcaccagccaggcccagctgccgacggccgccgcggcgaggatcggcaggcaggagccggccagtacggcgagcaccgtccggacggtgagccggtgtcgcggcagtcgggcgcagagcgggccgccgagcagcatcccgaccgtccaggaggccgtgaccaggccgaagacggtggtcgaggcgtgcagggtgtcccggatgaagaagacttcgaagacgttgatcgcaccgacgccaccgaccaccgcggcgatcgccacggtcatcacggccagtgaccggtcggcccgcagccggaactcgaccggcccgccggcctcctgccgggtgaccgcgccgcgccggcgggtgtggatcagcatcgccatcaccaccagagccaggtagctcgccgcgtcgatcagcaacggcacccgcggcccggtcgtcccgaccaggaatccggccagcgccggggcgatcagcgtcccgacctggccggcgctcattaccaggccgccggccttggccaggtcgtcgtcccgcaccatctgcggcagcagcgcctgcagggtcggctgggtcaccgcgagcccggcggcgagcagggcgaccagcgcgatgaccagccgggagtccgtggtgaaggcgagcagcccgcagatcagcgcctgcgccagcccgaccgtgaccagcagtgtgcggctgtccgcccggtcgaccagccggccggtgagcggggtgagcacggccatcgggacggcggaggcgagcagcagcccggcgacggcgaggccgccgtgcccggtctgctgcaggaccagggcgagggtggtcgcggcgagaaagtcgccgcagagggagatcgccttcccgccggccacgagatggacgtccgaccagcgcgactcagcagatgtgaaggacatacttcgaaagtaatccttcacatctgccggacgcaaccccggatcgaggtcagtccatcgggaatgccagatactgcaccgccacccggcgcgcgccgtccgtcgggttctcctgccgatcacgcacccggtacggctcgatcagggtcctgacctgctcgttcagcttggccagctcggccgcgctgaccagcagctgctggcccatgatgacgctggcctcccgccactcggtggtctcggtgccctgccggtccagccactcgtagatgcgctcccggtcccggctcagatacatgtcgatcagcgcgcgctcggcggccagcgcttccggctgctccacctcggcctccagccacaggttcttcccggtcgcccgccaccggcgttcccggccgtcgccctggctcggcgcctgctccaccagcccgtacttggccagttcacgcaggtggtagctggtcgcgctgggcgacagtccgacgaggccggccatctcggtcgcggtgaccgtcgccccggagacgttcaggtgatccacgatctcgatccgcgccggatgcgccagcgcccgcagcgtccgcgcatccgacacccgcacgttctcccgctcagccatgcccccattgtcgtaccgccggaaattcggtggacagcgctgcggggaggcgtagcgtggaggaccgcttgacggccgtggtgagcatgcaccgcagcgggcgtccccgcgccggcggcggcccatccgcacgaccggatacgcgagcgcagccgcagcaacgacctgccgaggatgcccgtgcccgcgcctgatctcgatgttcaactcgacgccgaacgcacccacctgaccgagtcacgggccgcgctgaaacggatgcggggacgggccgaggccctgttcgccaccggcaatcaggtggccggcgacgcctacaccgccgagcagctgggccggcacatggcccgccgggtcaaggagctcgccgacgacccggacaccccgctcttcttcggccgcctcgacatcgaggagagcgcgtaccacgtggggcgccggcatgtcaccgacgacgcgggcgagccgatggtgctggactggcgggccccactgtcccgctcgttctaccgggcgagtgtccgcgacccgcagggtgtctcgacccgccgccggttcggtttcgtcaagggcgagctgaccagcttcgaggacgagcacctggatcgcggcgaggagctgggcaccagcagccggatcctgaccgcggagatcgagcgcccgcgggtcggcccgatgcgggacattgtcgccaccatccagccggagcaggacgagctggtccgggcggagctgtccgagtcgatctgtgtgcagggcgcgccgggtaccgggaagaccgcggtcgggctgcaccgcgcggcgttcctgctctacctgcaccgggagcggctgcgccggtccggggtgctgatcgtcgggccgaacaccgctttcctctcctacatctcggcggtgctgcccaccctcggtgaggtcgaggtgcagcagtccaccgtggacgagctgatcgggcgggcaccggtcaggaccgccgattccgccgctgcgacgctggtcaagaacgacgtgcggatggccgaggtgctgagccgtacgctgtggggccgggtcgccaagcccaccgagccgatcatggtgtccgacgggtcgtaccgttggcggatcgacgtcgagccgctgcgccggatcgtcgacgaggcccgccgcgagggcttgccgtatgcggtcggccgggagcgggtccgcgcccgggtggtcggcctgctgcaacggcagtcggaatatcgcaccgggaattcgccgggcgagacctggctccgcaagatgggcaggatcgccccggtcaccggtttcctggaggcgtgctggccggcggtcaccccggagtccctggtcgcggacgtgctgaccgatccgtcggtggccggtgacctgctcaccgacgacgagcaggcggcgatccgctgggtgaagccaccgaagacgccgaagtcggcccgctggaccgccggcgacctgctgctgctcgacgaggccgccggactgctggagcgggagaacagcttcggtcacgtggtggtcgacgaggcgcaggatctgtcgcccatgcaggcccgcgcgatcgcccggcgcagcgagcacggctcaatcacgctgctcggcgacctggcgcagggcaccgcgccgtgggccgccacggactggcaggacatcctcggccacctgggcaaatccggcgcgccggtggtgccgctgaccgtcggtttccgggtgccggaggtcgtcgtggcactggccaaccgcctgctgccggcgttgggcgtgaacgtgccggaggcggtctcgctgcgccgcgacggcgatctcgccgtcctcccggtcgccgacccggccgatctggacgcgcgcacgctggccgaggtgaccgcggcgctgacgcacgagggctcgatcgcgatcatcgcggccgacgccgcggtggaccggctccgcggccacctcaccgcggccggcatcgagcacgcgacgcccgacgacccggaggccgaggcgcgcgtcatggtcgtgccggccacgctggtcaaaggattggagtacgaccatgtcatcgtgcacgagccggccgacatcgtggccgccgagccgcgcgggctgaaccgtctctacgtggtcctcacccgggccgtcacgcgtctgtcggtcgtgcacgccacaccgctccctgaaccgcttaacatcacctgatgccccgcctcggagtgatgttcgaccgcgatctgtcccccgaagacctgccggccttcgccaccgccgtggaggaggccggcgccgacgacctctgggtggtggaggacctcggctgggccggttcgatcagtgcggccgcactggccctggccgccacctcccggatccgggtcgggatcggcatcgccccggccccgctgcgcagcccggcgctgctcgcgatggagctggccatgctggcccgggtccagccgggccgcctggtggccggaatcggtcacggggtgtccgagtggatgcgtcaggtcggcgtcgagccgacgtcgaaactggccatgctggaggagacggtccgggccgtccggggtctgctgcgcggcgagacggtgacgctcgacgggcgggaggtgcacatcgacggcgtacgcctggtgcacccgcccgcggtcgtcccgccgatcgtcaccggtgtggtccggccacgttcgctggagctgtccggccgggtcgcggacggcacgatcatcgccgagggcaacggcccggcgcagttgcgggacgcgctcacgcacatccggcggggtggcgccgacgacggtcacgagctgatcgtctttacgtatctgcacgtcaacgacgatccggcggacgccgcgagggtgaccgggcagatggtcgagggccaggccggctggctcggcgtaccgccggaagaggttttctcgctgatcggcccggtcaccgaggtgcccggcaaggtcgccgcgctgaccggggcgggcgccgcgacgatcgtcctgcgaccgctgggtcccgatccggttccgcaggtcagggccgcgctggccgctctcggtcgctgaccagccggatcatggcggcgaccggcagcgacgggttgccggccgccgattcggccacccgcgggtccgggtcggcgagcagtgcggcgatccgcccgggtggcagtgccgggtgcccggccgcgatcgcccgcgcccgatagtccgacggctccactgtggcgagacagagctccagggtcgcggcgtccgcgttcgggtggcgcgcgatctcgcgcagtgccttcggcacgcgcggaatcccccgggcgagctgccgcaacaggtccgcgggcgcgtccggatttccggccacctgacaattgacgcgtacgccgtgaaccgccaccatcctcccgagcaccgccccggccaaccccggatgtccggccaccgccgcgaccaccttcgcgtccggatcctcggcgagcgcgtcccgcacgtcgtccggcaggtcccgccggaccgccaccagcatccgcagctccgggtcggcgctcgccgcgagatcgcgcacctcggcctcggtcgcggccgcgacccggggcagcaggaccggcccgatccgggtcgtgccggtcagccgggccagcaccgccagcggcagcgccggattcctggccagccgctgccggaccggtgccagcgggtccccggccaggcgctcgatcaggtcgggcgccaggcccgggttctcggccagggtgtgccggacgcccggtgccgggtcggtgaccagccgctcggccgcccagtgcggcaggtcgggccgtgcggccagggcataccgcagggcgagcggcggatccacggccagccgcgcgaccgtcccggccggcgtggacgggttgtccacagcccggtgccgcaggttgtggacagcggattcgtggctgccggtgcagcgggcgccgggcggcagggtgcagtcgccccgcaggcagtccgggtcgtgccggaacgggatcggctcctgctcgcagacccggcacaccgcggccggcgggtcgttcgcgaccaggacgacgagcgtctccggcggggtggccgggttgcccgcgaccatcgcgcggacgtcggcgttcttgccggcggtcgcggcggcggtcgcggcggcgttctcggcggccagcccgatcaggcggtcgaccagggcgggcggcagcgcggggttgccgcagagcgccaccagaaggtcatccacgaacgagcatcctgacccctgcggcacccgggcggaaggctcgctccattgcggattcgtctcactgcgtggaatcgccgagcgatttcacccaacgcgaccactcgcgttgactccggtagccgtacgcggcccagatgccgtgcgccccggtgttggcgtccaacaccatcgcgtccgcacgggtaccgcccagcgcacggaaccgctgctcggcggcggcgatcaggcgaccaccgagcccggcgcggcggcggtccggggcgaccgccagccggtagaggtggcaccgccagccgtcccagcccgcgatgatcgtgccgacgatcttgtcgccgtccacggccaggatcaacgcctccggatcccgacccaccagcgcctcgaccgccgccggggtatccgccggccggctgtcgttctccgccgccgacgcccagaaatccaggatccggctccactcggaagcctgcgccgctcgcaagatcacatctcccacgcaaccaccttaggaccccgcgccgcgcgtccggcttggcggcgggaagtgaccgattccgtacgcgcccattccccgctcgcgtccggcgaccgatcgtcgtcctcatgccgcccggcactcggctggtggatgggcgacagtttcgcccgggcggccgtgtccggatgcgaccatgcggctatgaccgctccatcgcccagcgggcccaactgggtggatctggccacgtccgacctcgacgccgcgatccggttctacacgagcctgttcggctggaccgccgacgtttccggcgacgacttcggcggatacacgacgttcctgctcaacggcctgccggtggccggtgccggcccgctctacggcgaggggcagcccaccgcctggagcacctacctggccaccgccgacgccgatcggagcgccgccctggtcgaggccgccgccgggaaagtcctggtcgccccgttcgacgtgatggatcagggccggatggccgcgttcctggacccgtccggcgctccgttcagcgtctgggagccccgctcgatgcgcggcgccgaggtcttcgacgtccccggcgccctcacctggaacgagctgaacacccgcgacctggacaccgcgcgcaccttctacggcgcggtcttcggctggacgttccgcacggccgaggtcggcggcctgccctacctgctgtgcgacaacggccgccggccggtcgccggcatccacccgatgaccggggacggctggtccgacgacatctcaccgtactggctgacctatttcgccaccggcgactgcgacgccgccgccgaacacgccttcgccctgggcggccgcatcatcagcccgccgacgacgatcccgatcggccgctacgccgtgctcaccgacccccagggcgccaccttcgcgctgctcaccaccgcccgccgatagcccccacccgcgcgccgccgcacaatgagaaggccgccccggggagcggcctcttgcggtgtcccgcgctcagtgcagcaggtcggggatcttgtcaaagagctgaccggtgtacgtgatcatctcgtgcagcatccagttgccggagaacagcagcatcgcaccgatcgccaccgccttcgggacgaacgccaacgtcgcctcctggatctgcgtcaccgactggaagagcgacaccgcgaagccgaccgccagcgcggtcagcagcaccggcgccgccaccttcgccgcgatcgtcatggcctgcagtcccagctcaaccaccatcgtgtcggtcatgcccgcacattcgggcgcttcgggccacctcggagtgcagaccggtcgcgccccggttgcggttcggttcgcaccccgcactttcctcaagtcggccgcaccactgccgcgcgaccggcaacgagcccggccggctcaggagcggaccgccaccaccagcgggccgtgatcgccggcgatcacccggaccctgacccggtagtgctcggccaggttgctctcggtgagcacctccgtcggcgtcccggccgccaccacccggccaccggcgagcatcaccatccggtccgcgtactccccggcggtggacagatcgtgcatggtggccagcacggtcagggcacgctccgcccgcagccggtccaccagctccaggacctcctgctggtggccgatgtcgagggcactggtcggctcgtcgagcagcaggatccgggcgccctgggcgagggcccgggccaggaagacgcgctggcgttcgccgccggaaagggtgtccagccggcggccggcgaacgggaccaggtcgagcgcggccagctcctcgtcgacggcggccaggtcggcggcggattcccggccgagcgccgggatgtacggggtgcggcccagcagtacgtagtcgaaaacggtcatcgcgggtgggacgacggggttctgcatgaccaccgcgatcgccttggcccggtcccggcggtgcaaccggtcgaccgggctgccgtacaaccggaccgacccggtgaacgggagcaggccggccaccgctcgcagcgccgtggacttgccggcgccgttcgggccgatcaccgtcacccactcgccctcgccgacactcagggtgatgttgtcgacgatcagcgccccgtcccggcgtaccgccagatcggcgaccgcaatcgccgcggtctcgcgaccggggctgctcatgtggcggccgatcgtgtcgtgcgcagcacgacgacgaagaacggcgctcccaggaacgcggtgaccaccccgatcgggatctccgcggcgccgccggcgacccgggccagcaggtcggtaagggtcaggaaggcggccccgaacagcaccgacagtggcagcagcgagcgatagctggggccggccagcaggcgcagcgtgtgcgggacgatgatgccgacgaatccgatcaggccggagacggagaccgccgcggcggtgcccagcgacgccgcgacgatcagcaggtagcgactacgctgcggatgcaggccgaggctggtcgcctcctcgtcaccgacggtcagcacatccagttcgcggccctgggtcagcatgatcgccgcggtcagcaccgtgtacggcaggaccacgagcacgtcgtgccaaccggcggtggcgagccggccgagcagccaggaatacacctcgcgcagcgactcgacgtgccgctgcagcaggtaggtctgcatcgcggcgaggaacgcggagaccgccaccccggccagaatcagcgcggccggcgatcggtcgcggccaccgacggcgcccagcacccaggtgagagcgaccgcgatcagcgcgccggcgaacgcggcggccggcacgccgatcggcagaccggcctcggccgcaccggccgggcgcagcaccagcaccgcggtcacccccaggccggcgccggccgcgaccccgagcaggtgcgggtcggccagcggattgcggaacgcaccctggtaggcggcgccggccagcgacagcatcgccccgaccagcaggccgaggacgacccggggcagccgcagctccatcaggatcgcgacgtcgcgttcgctgagcccgctgtgcaggcggacccccgggatcaggttgagcagttcggccgcgacgccgccgggcggcagtgagaccgagccgaacgcgaggccggcggtgaccgcgaccagcacggacagcacgccggccagcagccaggccgggcggagcccggccggtctcatgacgccggaaccttgctcaccgcgtcggcggcggccgaactcatgacgcggggaccttgctcaccgcgtcggcgacggccttgaccaggtcgacggtgcgggggccccagcgggacgcgatgtcgtcgtcgagcgggtagatccggcccttctgcaccgcggtgatcgacgcccagcccttgcgcgccttgacgctgtccgcggactgccggcagcacttggtgtcggccaggaagacggtgtccgggttcgccttgaccagcgtctccgcggacagttgcggatagccgcccttactgccgtcggcatcggcggaatcggccacgttggtcatcccgaacaggtggaacaccccgccgatgaacgtcttcgacgtcgccgagtacagctccggccccagctcgtagaagtaggagagcggcttggtgcgcgccggcacgcccttgacgatctgatcgatctcagtcttcatcgtctggctgagctgggtggcctcgccgctgtgcccggtcaacgaaccaagttcgtcgatttcccggtacgtgtcgtcaagcgacgccgcggccggcgacacgaacgtcgggatcttgagcttgcccagctgagcgacgatctggtcggcgtcgccggagagcacgaccaggtccgggttcttcgccgcgatcgcctcggcgttcggtttgaagccggacaggtcggtcttgggcgcctcggctggatggttcgactggtcgtcgaccgcggtgacctgcggcccggcgccgatcgcgaagagcatctcggtggcggtcgggctcagcgagacgatcttctccgggcgggcgccgagggtgagtgggccgaccgtgaccgggaagccggtgccggccgaactcgccgcggcggccggctccttcgtcgagtccgccttgtcaccacaaccggtgagcagcagcgcagccgcggtagcggcgatgatcgcgcgtttcatcaagtcctcctgtcggccgggcatggtgcttcgccgacaggggcttgtggccgccgcccgcgaggcgcccctccccgggagcgctggttcgcgaccgcggccagaggcgacctggctagacctcgtggtgagggatcacagttgcgggacagctccggtttcccaccggcttcgctgtggcgcggtcagctcagacgctatctcacctgccgcccgccggtgatcaggcctcacacatccccccagccgcgcgctcaccggccgcgccgggctgcccgcccacacgcccggccctgccagggatgccgcgccgcctactcgccgggcgtcactagcgcgccctccggctgccgacgccgctctgctcttccgggacggctacttgccggcttccgttctgccctccgccttggcgccctcggttttgatctcgccggcggcggcagccgtctcggtgtccgcactgccggccgcagcggcgtcggcgatccggtcgccaccgctggtggcgtcggcggccgctacccggtcgccggccgcggcggcctcgtcgtcgccggccagggcggagcgcagccgcgccttctccgtggcgcggcgctgggcggacgcgccgagctgctcggccatctcgtcccgccacttacggagcacgaagaacgagaacccggccgaggcgacgaacgcgatcatcgccttgaccaggatgttcagcggcaaggggaagagcgcggcgaacaccaccaggaacaggccgatgcggcccagcgtgtatttgacggcgggactcatgatctctctccctcagccggagcgctggcgcagccagcggaggccgtagaaccagacgaagcagtggacgaccgcggcggtcaccgcaccggcgccgccgctcaccaggggaggagcatacggtgcgacgacaccggcgatcgtcatgccggcggccgcaccgaacccgatgcccagcaccgccgccagcacccggtcggcaccgaagccggccgcccggaactgctcgacgaagagccacaccggcaggatcaggatcagccagccgttggtttgaccgaaccgggacaccccggtcagcaccaggatcccctccagcaccagcaccacggcgatgccgacgaccagcccggcgaaggccgcaccgagcagatcgcccaccgtcgccatcgggccggaatcccgccgcaggccacctgcgctccgctgctgagtcatcagaaaaccttaggcccagaccttctgcggttcgctgcgccgctcggccaggccgaccggcttctcatactcccggacgacctcgtaccgcgtgttgcgctcgaccggctggaagccggcgtcccagatcaggtgcagcaggtcgtcgcggtgcatggtgctgggcgtgccgtacgagtcggcatcgtgagtgatcttgtactcgaccaccgagccgtccaggtcgtcggcgccgaagttgagcgagagctgggcgaccgagagcccgtgcatgacccagaagcacttcacgtgcggcacgttgtcgaacagcagccgggagaccgcgaacgtcttgagcgactcggccggggcggccatcgtggtgcgcgcctggatccggttgcggacgatgccgtccgccgagtcgtggaagtcgtgctgatagcgcagcgggatgaagacggcgaagccgccggtctcgtcctgcagctcgcgcaggcgcagcacgtggtcgacccggtgccggggctcctcgatgtggccgtagagcatggtggccggggtccgcatccccttctggtgggccagccggtggatccgcgaccagtcctcccagtggcaggcgtggtcgacgatgtgctgccggacctcccagtcgaagatctcggcgccgcccccggtcagcgactccagcccggcgtccatcagctcgtcgaggatctcactggcggataggccgctgatcttctcgaaccactggacctcggtggcggtgaagcacttgagcttgacgttcggcagcgcggctttcagctcgcgcagcaccttggggtaataccgccagggcagggtggggtgcaggccgttgacgatgtgcagctcggtgagctgctcgtcctccatctccttggccttgcggaccgcctcgtcgatgcgcatcgtgtacgcgtccttctcccccggcttgcgctggaaagagcagtacgcgcagctggcggagcagacgttcgtcaggttcaggtggcggttgacgttgaacatcacccggtcgccgttgagctcggtgcgccggtggtgcgccagccggccgagccaggccagatcgtcgctgtcgtagagcgcgatgccgtcctcgcgggtgagccgctcaccggcgtagaccttcgcctcgaggtcacgcttcaaaccggcgtccatgctcgcccctcccatgtccgcgcctttgccgaatctcgggtcgagagtacgtgccgggtctgacaacgagcacggggccgggccgcccggtggccggccacactccggattcggcgcgttgaccagccgcttcagagctccacagcggcaagtcgagaaattctcagggtcctttcaccttctttcgatcgacagcggtgcgcggagtggggtaagaaccttaaggaaccaattgcggcggccggcggtcgccccggacggggagctcatgtcgaaggcactgcggtacggacaggattcatcacgctccgtgcatgcgcgactccgacccgtcactctgtcggcggctgtcgcggcagcactggctgcgctgttccagccgatcccggcgatggccgcgcccggcgacggccagccgatctcggccggtgtgccggattccggctctcgccccacccaggtcggttccctcgtgctgcccaacacgccgatcagcaccacgccggtcagcaccatccccggctcggcgaccaacaaggtgctccaccagatcgagcagggccgcatccaggtcgaccagctcggtgaccagctgctccagctgaaagccgaccgcgacctcgcccagggccaggtgagcaccgcccaactgaaggtgagcgaggcgcagaccggcctgcagagcgcccagaccgacgcggtcaccgcggccggtcaggcgatgcagcaggccgccgcggtcccgcccggcgcgctcgactccggcctgctcggcctggaccagctggcccgcctgcagcgcggcgagaaaccgaccgacgccacgaccgcccagcacctggagtccgccgagatcgccgcgcagatcgcgatcgacgagcagaccctcgccaccgagaaatacgacggcgtcctcaagcagtacgagaagctgaacgccacgctcaccaagaagcaggccgcccagcagaaactggaagccgcacacaaggacgagctggccgccgccgagagcgtcgcgaacgccgccgaccaggccctcggcgcgcagtatctcggcggcgcctcggccggtcgcggagccgacccgcgggcgatccaggcgctgcagttcgcgctcgcccagcgcggcgatccgtacgtgtggtccgaggagggccccgacgcgtacgactgctccggtctgatcttcgcctcgtaccactcggtgggctatcccatggtccgcgtctcccgcgaccagtactggcagacccgcaacaaggtcgtcgaccggtattcgctggtccccggcgacctgctgttcttcagctacaccaacagctggaccggcatccaccacgtcgcgatgtacgcgggcaacggcatgatggtcgaggccccgcgcaccgggctgaacgtgcggctcgtgccggtccggtggagccagctcttccaggccacccgggtcttcggctcggtcgagggcggcacgaccggcatcccgctgggcaccgccgatccggaggagccggccaccggcggtggcaccaacggtggtggccacaccggcggtggcggcgcgaccccgagcaccaaaccgaccaccaagccgagcaccggcggctccagcacgccgaccaagaagccgcggccgccggcgagctccgccccggccaagccgtcccccacgccgggcccgtcgagcagcagcccgagcaccggcacctcgacgccggccggcggttccagctccggcgggaccagctccggcggcacgagctccggtggcaccagctccggtggcaccagctccggtggcaccactagctagctagcccagcccgagccggccgaccgccagccgacgccgagcaagcctgataccgcacggtctgagccggccgaccggcagccgagggcgaatgagccgaagcccgccgaacccgagccggctgaccccaagccgacagaacccgagcccgccgaacctgagccggctgaccccaagccgacagagcccgagccggccgatccgaagcccgcggatccggagccggatgaggccgtgcccgccgatccggagccgggtgagcccgcgcccgcggagcctgagccggccgagccgcgcccgggtgagccgcgcccgattccggtcccgccgaaacccgcggctccgaagccgggcgagcccgagccgatcaagccgcagcccgggccgttccccacgccggtccctcagccggctccggcgcccacccggcccggcccgctgctgccggatccctatcccccgagccccgttccgcccggtcccggcccctcgccggtgccgccggtgccggctcccggcccggtgccgccgggtcccggcccctccccgatcccacccggaccggggccgagcccggttcccggcccgcccgggccgagtccggtgcccgcgccgcccggcccggcgccggtgttcccgccgcccccggtgatcgggaacggcctgccttcctacacgatgccgccggagggcggcggcccgacgggagtccttccgcccatgtcccacggcacccccggtaattccgacatgaccatgccgatcaacctggccacggccggcagcgacatgaccatgccggtgaacctcgccgcctccggcaccagtgacatgaccatgccgatcaacctggccgcggcgaacgccgacctcaccatgccggtcaacctggccggggcgaacgccgacctcaccatgccggtcaacctggccggggcgaacgccgacctgacgatgccggtgcaccttgccggagcgaacggcgatctgaccatgccggtgaatctggcgatggccaccaacatcgactccaccatgccggtgaattacgtgccgacccagccgggtccggcgcagcgcggcagcggtcagatctacagcaccggcggctacccgtcgatcgacatgacgatgccggtcagcgacccgtcggagaattccggttcgctgaccgggcacattctcgcccagggttggcacgacgcccaggtcgaccagcggcgcggcaatttcaaggtcatcgtggccatgctgatcgtgctggggctgctggtcacggtcagcctggtgttcgtgctgaccgtcggcagcagcctgagcggcatgttcaagagcttcggcggctgacccctgcacctacgggtatttgccgtccggaggcagctgccctaagctggcgaggttgtgctctgaggtgagcctgcccactacccgacgggaatgcggtcggggccgggagcgttcacccgtacacttatggcagttattgacgcggcgtgcccacccggtgcgcgccacgggcgttcttgcgggcaattcagcgggcggtttccacaggccaccgcggcgggccattcgcgagcatgcgcccccgtagagaggttctcttgaccactttcgctgatcccagcacgttcccgtccgttttcgagagcaacagcaccgagaccaccgaagccgtcgacaccgccacggcccccgccgcggagcaggagcagtccgcagccgccgcggagcaggagcaggccgcagccgccacggagcaggagcaggccaccgagccggccactgccgagcaggccgccgccgaaccggccgccatcgccgaggagcaggcagccgagcaggccgaggagcccgccgccgagcaggcgcccgtcctcaccttcgccgacctgggccttccggccgagatcgtgcgggtgctcacccgtgagggcatcaccaccccgttcgagatccaggccgccaccgtgccggacgcgctcgccggccgtgacgtgctgggccgtggccagaccggctccggcaagacgctggccttcggccttccggtgctggcccgcaccgcgcagggtggcaaggcccgcccgcaccacccgaaggcgctgatcctggtcccgacccgcgagctggcgatgcaggtcgccgactcgctgatgccggtcggccgcgcggtcggtgtcttcctgaagaccgcggtcggcggcgtgccgtacgaccggcagatggacgccctgcgccgcggcgtcgaggtgatcgtcgccaccccgggccggctcgccgacctgatcgagcgcggcgcctgcaagctcgacgacgtcgagatcaccgttctggacgaggccgaccagatggccgacatgggcttcctgcccgaggtcaccgacctgctgtcgaagacgccggagaacgcgcagcgcctgctcttctcggccactctggacggtgacgtggacgcgctggtgcagcggttcatgcacgacccggtgacccactcgaccgcgccggccgaggccagcgtgtccaccatggatcaccacctgctgctgatcccgccggccgagaagttcccgatcacctcgtggatcgcgaaccgggccggcaagaccatcgtcttcgcccgcacccagatgggcgtggaccggctggtcgagcagctgcacgcggtcggcgtgcgggccggcgccctgcacggcggcaagacgcagcgggtgcgcacccggaccctggccgagttcaaggagggccggacgaacgtgctggtcgccacggacgtcgcggcccggggcatccacgtcgacggggtttccctggtcgtgcacgtggacccgccgaaggacccgaaggactacctgcaccgggccggtcgcacggcgcgggccggcgagtccggcgcggtggtcaccctggtgctgcccaagcagcgccggaccacccagcagatgatggccaaggcaggcgtgtccccggccgaggtgcgggtgcggatcggcgacgagaagctggccgccatcaccggcgctcaggagccgagtggtgtcccggtggtggaggagccggagccgcggcgtgagcggtccggtggcggccgtcgcttcggcggtggcgaccggggtgaccgtccgcgctacggcgaccgtccgcagcggtcctacggcgaccggaacgaccgcttcggcgaccggccggccggcggcggctaccgcggcgaccgcccgaccggcggcggctaccggggcgaccgtccggctgacggcggctaccgcggcgaccgcccggccgagggtggctaccgcggcgaccgtccggctgacggcggctaccgcggcgaccgtccgaaccgtgagcgtggcggtttcggcgaccggaccgaccggcccgccgccgaccgcggtggcttcaacgaccgggaccggccgcgcgccgaccgcccgttcggggagcgcaccgaccggcacttcgccgaccgtccggcccgcaccggtgaccgtccgtccggccagcgccgcgacgggcagcgcatcgaccggcgcgagggtggcccgggacgtttcaactcgtcccgcccggcccgcagccactgatcgaatccaggtgaagccccggcgcgagccggggcttttccacagggtcatccacagggctggctcacgcgtaccaccgcaatcgtttcgaatgccgggtaacttgccggtatgggcgttctttccacagggttgttctgggaacgccgggatgtccccggtagcgagcatgtgcgcctcgacgcccggaacgggttgtatgcgcagggcaccgcgctggccgcggcgccgatcggttacgcgtgccactacgagatccagaccgatccgggctgggcgaccgcgcggctggatgtgcgcgccgagggtgccggctgggcccgcggggtgcgtctggagctggccgccgggcggtggcgggtgaccacctccgagcagggcgatctggatgcggcgctgctggccgccgggcacgcccgggccggtctgcccgggatcgaggacccggatctgctgtacggcgcgttcgacgccgacctgggtggttccccgctgaccaacacgctgccgatccgccggctgggcctgctcagcggggaaagcgtctcccaccggctgagtgtcgcgtgggtgctcgtgcccagcctggaagtggtgcaggcggaccagatctacacgccgctgggcgagggccggatccggttcgcgagcgagacgttcagcgccgacctgaccgtcgacgacgacggtttcgtcaccgactatccgggactggcccggcgggtcgtcacacccgctcgcggatccagctgaggcaggccttgtccaccgccgcgaacggtttgccgtaggtggcctgtgcagcctcgtccggcgccttcccgtcgcgcagcacctggctggtgaactgcagcagcttcggctcgccgtactgggcggccatgcacgcggtggcatagtggcccatcgcgtacagggtgtcgacggtcaggtcgtcggcgttgcgggccagcgccgggtaggcgatgctcttcggcaccccgcgccgggcgaacgagtccttcaacaccaggtgattgatcgtgtcctggggcttcttcggcagcgcgccgatgtactcggcgatcccctcgaccagccactgctcgtcatgatcgccgtggtagccctccgcgacggtcaccacgtgggtgagctcgtgctggatggtgaccgcgagcgcgctgaagtcgccggagaccttggctcgcaggatgacgtcgccgccggtggcgttcagcggaatctcgtagcccaccacccacttctggttgccgcccccgtaccaggtcttccagccctgctcatcggcgatgtagatgcggtagcgccgctgctcggtgtggatgtagccggcgtacctgtcgacgaccttggcggccttctccgccatcggcagcacctggctgatcagcttggcttgattggcggggccggccacgatcacccgcgagcccttcaccacggtcagctcccgtccgtcccacggcgccggctgcaggtcgttgtcctcggaggcgatcttctcggtcatcgcgacgatctggaacaccccggcgaccctggtgaaggtcacccggtacgcggcctcgggcggcccctcggtgaaggagaatttgcgccagctggggcaggcgacgccactgagacaataggcgagctgcacctcggcgacgatcgtcgagtcgttgccctggtccgggacccgggtggcgtggaactccgcgtggctgagctccagagcccgcaggttggtgaagatggtccggtaacgatcgaccatcctggtgttcgccgggttgagcggggcgagccagccttcctggtcgcccctctccagggctgtcgcctgcccctgcagcagcgccagcgcctcctcgaacggcgtcggggggcggctcggtctcgtggtggcggtggctttcgccggcttgtcggaggacggccagaggagcacggcgcccgcagcggcgaccgcgaggacgacggcggtcaccgcggccagaaaagccgtccggcgctgcctcgtgggcgcgagcgccgggccctcccacggcccgagcacggggccgtccagcgacccgaacggcgccaccgccgggctttccagcggtggcgccaccggatgcgaagcttcttccacgcgcggattcaatcacggcgcgtcaatattcaccgaactgcgagactcagcctacgccgggctgcggccggttctcccatttcgtggaaagtgcgatggccgtacgggtcgaggccacccctggcgtccggttgatccggacgatcagctgctccagctcggcgatcgtgccgacccggacgatcagttgatacgactccacaccggccatgaaatagcagctctccacctcgggcatggcgcgcaccgcggcgagcacgtcgtcggtgtcggcgccggagtcctcgacgatgccgatcagcgcggtgacgccgagcccgaccgcctcgtggtcgacgtcggcgcggtagccgcggatggtgccggccgcctcgagcttaccgacccgctcgtgcaccgcgggggcggagagcccgaccttgcgggccagctcggcgtacgacgagcgagcgttctcccgtagcaggtcgatcagccggaggtcgatggagtccatgcctgaaaccctaatcgggtggcccggcggcactcacgcccggtagcggcgaatggggggcaggataatgatcgttgtcgcaatcggggctttttccgcatttcacggacttggttcaggggcggtgctctaatggctttacgtcccgatcgagcatgccgacactcagtgtgaccaccggccgctccagaaaacagaaccgaggagggggttgtggacactggagaccgtctgctgacaccgggcgaggtggccgcattgtttcgcgtcgatccgaaaacggtcacgcgctgggccgcagccggccgtatcggcagcatccgtactccgggtggacaccgccgattccgcgaatccgaagtcaaggcccttcttgagggcgacggcgtgatcgaggagatgcgcgaggacgacgcggccaacaagccgcggaacagcggcccggccaacccgggtgcgggttacggcccgccgaacggcctgcgctgagatcagcgctcgccgagtcgcccgttccatcgccgcatcagggtgtgttccacacccagcgagtccagcaccttacccgcaatgaagtcgatgagttgctgtgcggtggcgtctgcaccggacccgtagaaaccggggctggccggcagcaccaccgcaccggcatcgtgcagagcgatcaggtgctccaggtgactgcgcgtcaccggggtctcccgcggcacgatgactgtccgtcgccgttccttgagattgacctcggcggcgcgctgcaacagatccttggagagaccgacggcgatgccggcgcacgctgccgtgctggccggcaccacggccatcccgcgcgccggatacgacccgctgctcgggccggccgccaggtcaccggccggccagtaggtcaggtcacccaggtcccggccgagccacgcggcgacgtcgtccttccagtgcgcatcccggatcgtcgccccggtctcgtcgagcagggtgagccgggccgcccgggagacgaccaggtcgaccgcctcgccggcgtcgagcagcgcggtgagcaccgcccgcgcgtacggggtgcctgaggctccggagacaccgacgatccagggttgtcgcatcttcccagtgttacaggacggccaggtcgagcaccgcgaagacgaacagtgcgatgccgatgaacccgttcgcggtgaagaacgcccggttgaccttggacaggtcggtcggggtcaccaccacgtgctggtagatcaggccacccgcggtcagcgccagcccgatccaccacagccagcccagtccgacgagctggccgaagagcacgaacagcgcgaacgtgaccacgtgcgtgaccgtggagatgtgcagcgcgaccggcaccccgaaccgggccggcgtggagtgcaccccgatccgccggtccacctcgacgtcctggcaggcgtagatgatgtcgaagccgccgatccacaggccgaccgcgaccccgagcacccaggccgggccggaaccgtggaaggtgccggtgatcgccagccaggcaccgaccggggccaccgcctgggccagcgccagcacgtagtgcgggaagtcggtgaaccgcttggcgtacgggtagatcaccagagggatcaccgcgagcggcgacaggaccaggcacagcgggttgagcaggcccgcggccaggatcaggacgaccagcgagacgatcgcgccggtccaggcggtccggacgctcaccgcgccggtcaccagctcccgattctgcgtacgcggattcagcgcgtcgatcctgcggtccaggatccggttggcggccatcgcgaacgtccgcccggacaccatggcgacggtgaccagcaccaggtcgagccagtgccgcccggtcccgtcccggtcgatcgcgaccagcgccgacaggtaggcgaacggcagcgcgaacaccgagtgctcgatcatcaccaaccgcagaaacgccttgaccttgccgggtttctccggtgcgacggccgtcatatcccgtattccttccagcgcttgtccaccaggctggtcacctcgggactcatcaccatctcctccggccagccgcggccgtagccctcggccggcagcttacgggtggcgtcaacgcctgccttgccaccccagaactgctggtaggacgcgtggtccaggtgatccaccggcccctcggtgagcagcaggtcgcgcgcgtagtcgacgttgccgaacgcccggaacgccacctcggcgtaatcgtgcacgtcgcagtcctcgtcgaccaccacgatcagcttggtcagcgacatcaggtgggcgccccagacggcgttcatcaccttctgtgcgtgcttcgggtagcgcttgcggatcgacacgatcagacagttgtggaagacgccggcggccggcatgtcgtagtcgacgatgtccgggatcagcagcttggtcagcggcaggaagatccgctcggtggccttgcccagcccgtggtcctcctgcggcggctgggaggtgacgatcgagtggtagatcggcttcctgcgcatcgtcatgcactcgatgtgcagcaccgggaacggctcgaccggggtgtagtagccggtgtggtcgccgaacgggccctccggcagccgctcccccggctccaggtacccctccaggatcacctgcgcgttcgccgggacctgcagcggcacggtgacgcagtcgaccatctcgacccgctcgccgcgcaggaaaccggcgaacatgtactcgtcgatgtcgccgggcagcggggcgctggccgcgtagcagaccaccgggtcggcgccgatcgccacggccaccggcaggcgctgcccgagccgctcggcgaccgcgtggtgcgcggtcgaatccttgtggatctgccagtgcatgccgagcgtgttcttcgagtgctgctgcagccggtacagccccaggttgcgcttgccggtctccgggtgcttggtgtgggtcagcccgaagttgtggaagatcccgccatcgccgggccagacctgcaggccgggcagtttcccgaggtcgacctcgtcgcccttgagcaccacctcctggcacggagcggtcttgaccttgcgcggcggcagcgacttgagctgcagcaccttgcccatgccctcgcggatcccggaccagccgaccggcagctccggcttgatcagcgcgccgatccggtcgccgatctcgtcgagcgattcgacgcccagcgccatcgccatccgcttctcggtgccgaacaggttgatcgcgatcggcatctcgccccgggtcggccgttcgaacacaagtgccggaccgttcgaccggacggtgcgggtcaccacctcgctgatctccagtgtcgggtccaccgggacggtgacccgccgcagctcaccggccttttccagggcggccaggaaactctgcagatcggcatagggaaacccacgagacgccatgcgcaccagtctggcaccgcttcgcgccgccggctcccgggggccgtcactcgtgatctgcgattcgcgttgaggggtcgtgacgctccgcagggtggcgcgctggtgcgcgctggccgggctggtggccgcgctcgcggtggccagcccggcgaattccgcgcgtccgggccggctgccggtctgcggcgtggccggtccgccctcgacccggccgccttcggcgccggcctcccgctcggcaccgggcgcctgccgggccaacgttctcgaatcggccgtacgcgtgagcaagccgcccgggttcaccccgagcggctaccaccacctcggtgcggcgaccagtgccgagtggagcggcgtgtccggccgcttcggtgtggtggacacgacgatccggcccggcacctacgacttcatcgcctcccgcttcatggtgaaacgggacctgggcaaggggaacatcgcctggctggaggccgggtggtcggagaccgggtgggcgtcggcgggacgcccgcacatctacacctacaacaccaacaccaaggcgtggcagttctacgaccagtatccggtgaagcccggcgacacggtctggctggacctgcacaccgactcggacggggtctggcaggcctggctgtggtggagcaaccggtggaacctgctgaccgcgcagaagctgccgatcggcggcagtgccttcgtcgagcagtacgtcgaggtccacgtcgacgacaccaagccgggccgggtcgacgtccccccggtgaaggtggacaacgtgcagttgcgcccggccggcggcggtccgccgcggttctggcgcgaggacgtcggcaccctcaccggtgtcgcccccggcctgcagcagaccagcggcggttactgcctgaactgggtgacccgcttcgacacctgggacgccggcgactgctagcgcgcgttggcgtagctgtgcaggccctcgaagaacaggttgacgccgaacaggttcatcagcatcgtcacgaagccgaggatcgcgatccaggtcgcccaggtccgcttgacgctcggggtggcccgggcgtgcaggtaggccgcgtagaccacccaggagatgaacgcccagacctccttcgggtcccacccccagtaccgtccccaggacgcctcggcccacagcgggccggcgatcagcgcgccgaaggtgaacagcgggaaggcgaacgcgtgcagccggaaggtgagccgctccagggcgaccgccgaggtggggacgcgcttgccgagcgtgtacgggaagcgccggctgccctcgtcgtaaccgttcttgaccaggaacatggcggccgggacggcaccgatcaggaagattcccgaggagatgatgatcgtcgtgacgtgcacgaagaaccagtacgagtgcagggccgggaccagcggcgcgggcggggtgtaggccaccatgtcggccgcgccgagcagcaccaccagggccagcgaggcgaacaggccgaggtgccgcagggccgggcggcgcagcagcacgccgacccagaccgtcgacccgacgaaggtcgcggagaggatgtactcgtacatgttgccccacggcatgcggtcggccgcgatgccgcgggcgaccagcgtggccgcgtgcaggaccagggcgagcacgttgacggccgcgccgatccgcccggagagctcgccgcggtcacgccgcaccggcgtcgcgacgaccggcggcacatcggcggcgaccggggccgcggcgcccgcgccgaccagctgccgggccggtcgcgcggccgccttgccgatcaggctgcgcctgccgaacgcgtactccccggcgtagcagaccatggcggtcaggtaggccagcacggtcagcgccatcagctggttggacagctgtcccatcagggcgttccttcctcggcgggccgggtcagcgcggcgaattcggcctcgaaccccggatagtcggtgcgcggcaggccaccggcttcgaccacgctaccgccggcttcctgatcgatagctgggagcacgcggaaccagacgcggcgccggtgcacgaagagcgagagcatcagtccgatcagcccgagcaccgcgccgaccagcagcagcgactgggtcgggtcgtatcggatggcgagcgtggcgaactgccgggtgccgaggaactccagcctggtgccgtcgtccagggtccaggtctcgcccgggtgcagggtgtgcgggcggtcgccgctgaccttcttcagttcgccgttggtgatctggccgcggtccagggcgtagaccgagccgggtttgccgacgtcgagccccaggttgccgcggtaggccgcgaggaacagcaccgggctgttctccgccgggtacttcgagacggcgctgccgtcggtgccgccggtcggcaggtagacgccctcgaacccgacctgcagctgctcgtcgcgctggttggtcttcgggtcgatgttgacgtccgggaactgggcgacgccctcgctggtctgcatcgcgtcggtcggcaggaacggcacgaccttggtctggctgacgccgtaccggtcggtgtagcgcagcaccggcgcgtacccctgaccgatcaggtgcacgttggcgtggtgcagccggagcgggtcgttgaccgtgaaggtggccggccggtacgcccccgagccctccttgacctcgaccgtggccaggaacgacttcggctgcccggtgctctggtaggtggcgttgaaccgggtcatccgcaggcagaactgcggcaggtcggccgcggtgacccgggggccgagcgccgagtcgtcgtactgcgtgatcgagtcgcagaagccctggtcctcgccggccaccagcagccggttgccgtgccagccgtaccagtggccgaaaccgaccccgatcagcacggacagcagggcgaagtggaacagcaggttgccggtctccttgaggtaacccttctcgccggagaccgcgaacccgccgtccggcagctcgcgcacccgggtgcggtacagcttgcggcgcagcgtccgggacagctcggcggcggcctcggccggcgccgcggcgtgcggccgggccggggtgtgctgcgggagccgctccagccggcgcggggcctccggcggcacggtccgcagggcgcgcgcgtggtcgcgcagccggggcagcacgcacccgatcagcgaggtgaacagcagcaggtagatcgccgcgaaccaggccgacgcgaacacgtcgaacccgccgaaccggtcgatccagggtgccagctgcgggtgcgcggtgtaatactgcgacacccgctcccggttgaccgaggtctgcgggaagtacgaccccgggatcgccgcgacggccagcaggaacagcaggaccagcgcggtacgcatgctggtcagctgccgccaggagttgcgcagcagcgcccacaccgggttcacccggcgcggcggcggcacctcaccggcctccgggcgttcctccaggaccgtcacagcagcgtccctccgccgaagtcgaaggtggtcagcagccagatcaggaagtggttccactgaccgctgaccagggtcacgccgaccgcgatgagcagcacgccgccgatcctggtgacccaccggctgttccggcggatcgcctggaaaacgccgagcagtttgcggaagaagagcccgaacagcacgaacggcagacccagcccgaggctgtacgcgagtgccaggatcaccgcgcggtcggtctgcccgctcgtggtggccagcgccagcaccgcgcccagggtcgggccgacgcagggcagccaggagagggcgaagatggcgccgaagatcggggcgccgatcagcccggcggccgggagcttgctgacccgagcctcgcgctgcaggccggggatcaccccgagatagcccagcccgagcaggatcaccagcacgccgagcacgaggttgagcgtctgctcgtgggtcttcagggcgatgccgatgttcgccaccagcgaggcgagcagcgtgaagacggtggcgaaaccgagcacgaacagaccgctgccggccagcacccggcccttgagcgccacggtccgggtcttggtggcggtggccgcgccggtggccacctcgaggtccgaaccggccaggccggtcacgtaggagagataacccggaaccagcggcagcacgcacggcgagaggatgctgaccaggccggcgaccgcggccgcaccgatcgccagcaccagcgggccgctggccgccgcatcactgaaggccgagcccatcagccgttcccctccgccgccacccgctccaccagcggctgcagctcgccggcggtggtggagcgccggatggccgccgcgatccggccctgccggtccagaatcagggtggccggggtgctggtctgggtcacgtcgaacttcagcgcgaccgagccctcgtagtcgtagatgctcgggtaggtaacccggcccttctcgaacgccttggccgaatcccggtcgtcccgcgagttgatcccgaggaacgtgacgttcctggccttcgtcgcctggtacgttttttccaggtcagcggcctcggcccggcacggcgcgcaccaggagccccagaagttgaccacgacgaccttgccgcggtcgtcggccacgttgtaggcaccgccgtcgagcaactcgccggagacatcaccgacctgcggccggtgcgcggtgtcgcactccaccacaccgttcgtggtggtgcagtcctgtgcccagttcttcccgctgccgcagccggccagggcgccggcagcggcggtggcggccagggcggcggcgagaaggcggcgcatctcaggctcccttggcggtcttggccgtggcggagagggcgaccaggtgcgcggccggctcggtgtagtcgatgccgaccaccttggccccctcgaagcggaacgaggtcaggctcgccaggccgcactgccgcttgcgcgggtcgtgccacaggcgcttgccctcgacgtaccgccggagggtccagatcggcagctggtgggagacgcagacggcctcgtggccctcggcggcgacccgggccgcctgcagcgcctcgaacatccgcttggcgatctccagatacggctcgccccaggacggggtgatcgggtcgcgcagcacccaccagtggcgcgggttgctgaacgcgccgtcgccgaccgagacccgcttgccctcgaagaagttggcgctctcgatcagccgtacgtcgctcgccgtctccagcttgaactcggcggagatcggcgcggcggtctcctgcgcgcgctccagcgggctggccaccacgtgcgtcacatcgcggccggagagtgcctgggcggccgccttcgccatctgatggcccagctcggagagatggaagtcgggcagccggccgtacaagatcttggtggggttgaagacctcgccgtgccggaacacgtgcacggtcgtcctggtcgactcgctcaactcgggctccccgctgcggcgcgcgcggcgtgcggcagcgcggtcgcgatctgctccagtgccgcgtcgtcgatcgcggtcgagacgaaccacgactcgaaggcgctcggcggcaggtagaccccgcgcgccagcatggtgtggaagaacgccttgaacgccgcggcgtcctgcgtccgcgccgtgtcgtagtcgacgacctcggtctcggtgaagaagatcgagaacatgtttcccgcgtacgacaaccggtgcgccaccccggccgcgctcagcgccgtggacgcgagctgcccgatcgtcgtggccagctcgtcgagccgcttgtagacgtcggcgtcggccagtcgcagcgaggccaggccggccgcgcaggccaacgggttcccggagagcgtgccggcctggtagaccgggccggccggggcgagccgggacatgatctcgcgccgcccgccgaacgccgccgcgggcagcccgccacccatcaccttgccgaaggtgaacaggtcggcgtcgaccgggtgcagcccggtccagccaccggcggagacccggaaaccggtcatcacctcgtcgacgatcagcagcgcgccgttcgcgtgggcgatctcggccagtttctggttgaagccgtcccgcgggaccaccacacccatgttgcccggggcggcctcggtgatgatcgccgcgatctcgccgccgtcctgggcgaaggccgcggtgaccgcgtcgatgtcgttgtacggcaggacgatggtctcggccgcggccgcgccggtcaccccgggcgagtcgggcaggccgagcgtggccaccccggacccggcggcggccagcagcgcgtccacgtggccgtggtagcaaccggcgaacttcaccactttcgaccggccggtgtagccgcgggccagccggatcgccgtcatggtggcctcggtgccggagttgaccagccgcacctcgtcgatcgcggtgcgccggacgatctcctcggccaggtcgacctcgcccccggtgggggtgccgaagctggtgccgagcgcggccgcccgctggaccgccgcgacgatctcggggtgggcgtggccgtggatcagcgggccccacgagcagaccaggtcgacgtagcgccggccgtcgacgtcggtcagccaggggccgctgcccgaggccatgaatcggggcgtgccgccgacggcgcggaacgcacgcacaggtgaattgaccccgccgggaatgatggtccgggcgcggtcgaacagggcctgggagaccggggcgtcctccggatacggaagatccgcggtgggatatgtcgtggtcacagcggttcccattctgtcagcgggcacggacgccgatggtgagagggttgttcacatcaccggaggatgtccggaagagcccggttcgcccgcgccggacgggccgattcgcgtctaagaggataggctgaccggcgtggagcgtcccgagctgtccatcacggttcatcgggcccccgacgaggtctcgatccagctcgcgggggaaatcgacgtgctcacggtcaccgagctggccgctctcgtcaacgaggtgctggccgccgagccgcccgggcgcatcgtgctggacatggcgggcgtcacgttctgcgactcacagggcctcggcacgctggtcgtgctcagccgcaaggcgcagcacaaccagaccgtgctggcgctggccaacgtgggcgatttcctgatgcgggtgctggacatcaccggcctgcggtccgccctcatgatcagcacctcctgacagccggcccgccggcggcggagggcccatcagcgatgctgtcacacccgggagatgcccggcgcgccgatggcgtcgcctgtggacaaccgtcagccgaaggtgccgctgaccctcaccgaggtccctgatccgccggtcgcgtccgcggaataggtgtcggcgccggcgtcacggccacccgccggaaaggtgtaccgggcgaagaaggtataggtccccggccccagcgtgtccttggacgagagcgtgaagtggtagaccaccgcacccgcctcctcggtgacgtcgctggtcacgctcgcacccggcacctgctggctgccgtcccgggcgaccaggcccggggtcttcgccacccggatggtcacccgcagcgcggtcagccgcccggtcgcccggatcgtcaccacaccgctggcccgggtcctgccgcccacctcgacggtgccggcggcccgcaggaccggggtcgcggccggagccgcggaggcgggccggccgggctggtgggacggtcgcggcggcgggctgctcggcggcaccgtcgggaagctggagggcggcggtggagcgggccggtcgggtcccgttccaccggccagtgcccactgggcgaatccgccgcccccgatgacggccgccaccgcggcggtcgcccccgcgatccggacccggggcgcccgccgccgggccgcccggtcccgcgtggccgtcccggtgacccggtccaggatcgcggcccggtccggccgatgggccctcacctgggcgcgcaggaccgcgcgcagctcatcctcggtgagtgtcaccgcgccgcctcccatccgccgatccgggccagacttccgccgagcatctcggccagttgtttcgcgccccgcgaggtggcgctcttcaccgtgccctcggagatcccgagggtcgcggcgacctcacgctcggacatgtcgaacgcgtaccgcagcaccacgcaggcccgccgccggtgcgggagccgggccagcgcgcggcgcacgtcgagcaccgccggcacgtccgactccggcgcccgcttgagcacctccagcgagaagaggcgctcccggctgcgtcgacggatccagttacgggccaggttcatcaggatcccgtgggcgtacgctgccgggtcgtccgccgcctgcacgcgttcccagtgccgccacacctcggtcagcgtgtccgccgccaggtcgtcggcggccgacgcgtccccgatcatcaggtacgccagccgggacaacgagtcgtagtggcgctcgaagaacgcgtggtaggcggcgtcgcgcatcacttgaaggtgatgtcggaatccgagaacttgcagttgaggccgtccgcgccggacccggcctcggtcggctcggcgccggtgctgttgcccttgaacttgtcgcagaccttcaggccgggaaagcccaccacggtgatgttcgacagcgtcgcggtgtcaccgaagttcgagttgatgccgaccagcgccttggccttgccggtggcgatcacgttctgcacgatcaccgagcgcttgacctgagtcttgcagttgccgcacgagcggtacagcttgccgtagtcgctgacctggaagttcttgatggtcagcgtgccgccgccgttgtgctggaagaccttgtcgtcggcgcccctggccccgccgccgttgaccgtgtagaccgccgaggtgccgcccttgaaggtggccgcgtcctcgccgacgttctcccaccagacgttggtcagcgtgcaggagccgaggcagtgcacgccgtcggcggccgggtcaccgaggatcacgttcgacaggctcgcgccgtcggcgagctcgaacagcgggccctggtcctcggactgcgagtcggtgcccagcgcgccgctgccgaagaagcggacgttgccgccgtcgagactgctggtcaccttgatggtgctggtcacggccttctgcccggtcggggtcggccaggtggtcgacgcggccggagcggtggtcgcgctcttcgtcggcgtcgcgctcttcgtcggcgccgcggtcgcggtcttggtgggtgtcccggtcgcggtcctggtgggggtggcgctggtcgccggggaaccggtcgcggcgccggccgggcccaccgccacgtcgtcgaagtccgccgatcccctgctggtgaccaggccgatccgccccttggcggacagcgtcccggtcccgccgccgatcgcggcgccgtccacgaagcccttcaccgcgctgcccgaggcgtcgatccgcagggtgtgccaggtcgtcacgccgctgaccgcggccgacgcgagcaccgacaccacgctgcccttggcggcctgcagctcggccctgccggcaccggtcagcaccagccggtacatcgtcgaggagctgctgacccgggccgcgactccggcgaggccgccgctgcccaggctgatgcccttgaccttggccgagaccgaatagtcggtccaggtggtctccccggcgaggacccgcgccaactgactgtccgctttggattgccggtacgccttggatccgtccgtcacgaccgaccagtcgccgccggatttggaccaggcgctcacgccgttctcgaagtcgtcgctgaacatcgtgctggccgaggcgttggggacgaggaccgccacgagcgcggtgaccgcaccggcggcgccggccgcgccgactccggtgatgatccggcgacgacgacggcgcgcggcctgggcgtcgtcggggtgtgcgtgccgcatgttgctcctaagcttctgggggacgaggcttcgaccgcttgtggtgcgggcgatcaacttcgttgctcccagtgacccaggtcacatgaacatcagcttccccagcgcgccttctccagcagagccagcgcctcggtcgcggcgtcgtcgccgccggcccggagcacgcgcgccgcctcgtcgaccgtctcggtcagccgcagccactgcgcgtcccgctccttggtcgcctcggcctgcgccttgagctgctgatttttcgtccagagctcgacgaagacggacaccttggcacgaagcacccacgggtcgaacggcttggtcaggtaatccaccgcacccaccgcgtaaccacgcagggcgagctgggcgtcccggtcggccgcggtcaggaagaggatcggcacgtgccgggtccgttcccgccgcttgatgtggctggccgtctcgaagccgtccatgttgggcatgtgcgcgtccagcaggatcaccgcgaagtcgtcggtgagcagctgcttgagggccgcctcaccgctctccacggcgacagcggtcaccgggaggccctgcaggatggcctccagggccagcaggttgtccttccggtcgtcgaccagcagtgctttggcgcgctcacccacgcgtgctcacctcgtccctccccaccgtcagccgttctccggctcggcggactcctcggcgttcacccagcgagccatcagggcgatcagctcgtccaggtcgaccggcttggtgatgtagtcgctggctcccgcggcgagagccgactcccggtcaccgggcatcgccttcgccgtcaggaacactaccggtagatcccggaaacgctgattgcgccggattccccgagtggtctcatacccgtcctggtcgggcatcatcgcgtccatcagcacgatgtccacctccggatgctcgttcaggatccgcaccccgtccaccccgttgtccgagtacaggacgtgcagcccgtgcatctccagggcgctggtcagggcgaacacgttgcgcacgtcgtcgtcgacgatcagcacggtggcgccgtccagctgccggccggccgggtgcaccgcggccggctcctcctgccgcggcgcgcccagcggcgccatctccagcggcaggtcgagcgacgtggccggccgtgccgcgaccgccttggtcgtggccgcgggcagggccggcatcgggatcgtgtccggggtcagcgcctccggcatgtagagcgtgaaggtcgacccctcgcccggcaccgaacggaccgcgatggtgccgccgagcagcgccgcgaactcccggctgatcgacaggcccaggccggtgccgccgtacttgcgggtggtggtgccgtcggcctgctggaacggctcgaagatgatcgccagtttctcgtccgagatgccgatcccggtgtcccgcaccgcgaacgcgaccacctgtcgcgccgagaccagcgccggcacgtcgtcgctctccggggacggggcgaagatgcgcagcgtcaccgagccgttgtcggtgaacttcaccgcgttggagagcaggttgcgcaggatctgctggagtcgctgcgggtcggtgacgatcgagtcgggcaggtccggtgccagctccacctccagccgcaggcccttctcctcggcctggggcacgaacgcctgctcgacgtagctgcggatgccgtcgaagtcgaccacgtccggttcgacgtccatccggccggcctcgatcttcgacaggtcgaggatgtcgtcgatcagcgagagcaggtcggagccggcgctgtggatggtccgggcgaactcgatctgcttgccggtcaggttccgctcggtgttgtcggccagcaggcgggccagcaacaacagcgagttcagcggcgtacgcagctcgtggctcatgttggcgaggaactcggacttgtacgtgttggcccgggacagctgctgcgccttctcctccaggccgagccgggccagctcgatctcccggttcttcagctcgatgttggccttctggtcgctcagcagcttggccttgtcctccagctcggcgttggtgcgctgcagctcggccgactggtcctgcatctcccgggccagacgctgcgactggctgagcaactcctcggtacgccggttggcctggatcgtgttgagcgccaccccgatcgtggcgaccagccgctccaggaaggtcaggtggagtccggagaaggcggccaccgaggcgaactcgatcaccccgagcatctcgccctcgaacagcaccggcagcaccaccaggtcgttcggcggcatggcgagcagcccggagcgcatggtcaggatgccgtcgtgggtggcccggacccggatcgtgcggcgcgagaccgcggcctgcccgaccaggccctcaccggggccgaaggtcacttcatgatcacgagcgacatagccgtacgacgcggccagccgcagccggatcaccgcctcctcgttgtcgaccaggaagaatgcgccgagctgcgcgtccaccagcggcgtcacctcggtcatgatcatgcgacagacctcgccgacgtcccgctggccctgcaacaggccaccgatgcgggccaggttcgagtcgagccagccctgctccgcgttcgtcttcgtggtgtcgcggagcgtcacgatcatctggttgatgttgtccttgagctcggcgacctcgccctgcgcctcgaccgccacgctctgcgtcaggtcgccccgggtcaccgcggtggacacctcggcgatcgcgcgcagctggatggtcagggtcgaggcgagctggttgacgttgtcggtgaggtcccgccacgtcccggaaacgcccttgacctgggcctgtccgccgagcttgccctccgagccgacctcccgggcgacacgcgtgacctcgtcggcgaacgacgacagctggtcgaccatggtgttgacggtgttcttcagctccaggatctcgccgcgggcgtcgaccgtgatcttctgcccgaggtcgcccttggccacggccgtggtgaccgaggcgatgttgcgcacctgggcggtcaggttcgacgccatgtagttgacgttgtcggtcaggtcgcgccacgtgccggccaccccgcgcacctgcgcctgcccacccagcttgccctccgagccgacctcccgggccacccgggtgacctcgtcggcgaacgacgacagctggtcgaccatggtgttcacggtgttcttcagctccaggatctcgccctgggcgtcgaccgtgatcttctgcgagaggtcgcccttggcgaccgcggtggagacctgcgcgatgttgcggacctgactcgtcaggttcgacgccatcgagttgacgttgtcggtcaggtcgcgccacgtgccggccaccccgcgcacctgcgcctgcccacccagcttgccctcggtgcccacctcgcgggccacccgggtcacctcgtcggcgaacgacgacagctggtcgaccatcgtgttgacagtggacttgagctccaggatctcgccgcgggcgtcgaccgtgatcttctgcccgaggtcgcccttggccacggccgtggtgaccgaggcgatgttgcgcacctggctggtcaggttcgacgccatgtagttgacgttgtcggtgaggtcccgccacgtcccggaaacgcccttgacctgggcctgtccgccgagcttgccctcggaaccgacctcgcgggccacccgggtcacctcgtcggcgaacgacgacagctggtcgaccatcgtgttcacggtgttcttcagctccgcgatctcgccccgggcgtcgaccgtgatcttctgcgacaggtcgcccttggcgaccgcggtggagacctgggagatgttgcggacctgggcggtcaggttcgcggcgagctggttgacgttctcggtgaggtcccgccacgtcccggaaacgcctctgacctgtgcctgtccgccgagacgaccctcggtaccgacctcgcgggcgacgcgcgtcacctcgtcggcgaacgacgagagctggtcgaccatggtgttgacggtgtccttgagctccaggatctcaccctgagcggccaccgtgatcttctgcgacaggtcgcccttggcgaccgcggtggagacctgcgcgatgttgcgcacctgactcgtcaggttcgacgccatcgagttcaccgagtcggtgaggtccttccaggtgccggccacgttcggcacctcggcctggccgcccagcttgccctcggtgcccacctcgcgggccacccgggtgacctgctcggcgaacagccgcagcgtgtcggtcagcccgttcatcgtgtcggcgagttcggcgacctcgccgcgggccgacacggtgatcttctgcgacaggtcgccgcgggccatcgcggtggccacctgggagatcgagcgcacctggtgggtcaggttggaggccatcaggttcaccgagtcggtgaggtccttccaggtgccggccaccccgcggacgtcggcctgaccgcccagctcaccctcggtgcccacctcgcgggccacccgggtcacctcgtcggcgaacgacgacagctggtcgaccatcgtgttcaccgtccggccgatccgcaggaattcaccgcgcagcggccggccgtccatttccagcgccatgtgctgggagaggtcaccctcggccaccgcgccgaccacccgggagatctcggtggtgggccggcccagatcgtcgatcagcgagttcaccgagcgcacgctgtcggcccaggagccgtccagcccctcctcgtccaggcgctcggtcagccggccgtcgcggccgacgatccggctgatccgccggaggtccagattctgccgttcctgcagcgagacgacctcgttgaaggcctccgccacggccccggcggcaccaccgcggcggggcaggcggaccttgagatcaccgcgccggacccgtcgcagggcgtccgcgagctcaccgaacagaacggtctcgtcgggcccgccgacgctggcttctttggccgcagtcatgctgtcctcactcgctgtccacctgccgggctacctatcctctctcgcccgaccgggtcaatgcgagagacgactttgtgcatacacccaccctcgggagaggatgcatgctgtgccagccgaggtcggaaccaggacgagcgtcccgtcgggagcgccgaccggcaccctcgtgcgcaaagcccgcctgcccaacgaccggcgcacccccgcggcggcgcgcgcgctggtccgctcggtgctcgaggaggccgggctggacggcctgctcaacgaggctctgctgctgaccaccgaactgtccaccaacgcggtcgtgcacgccaacaccgacctggacatcgaggtcaccgccgatccggccgggctgaccgtgacggtcaccgacttcgcccccggcccggtcgagcagctcgccgtcggccccaggaacgagagcccggacatcggcgaggtcgccgagcgcggccgcggcctgctgctggtcgaccacttcgccagccgctggggcaccgtgcacgagggcgacggcaaaggcgtctggttccacctcgaccatcacgcgccggacggtggcgacgggtcccggatcccgcccccgtccgacgcgcccagcctcggcgcgctcaccgccctgctgcgcagcggctccgaccggcagaccgacgagggcctcaccgagctcgccgccgacctgctctcccggctggcccggctgaccggcgcggccggcggggtgctccgggtcgaccgcggcgacgggatgggccggcagctgctcgcccggtacggccgggccccgcgggacaacgccgacaccatccgcgtcccgctgaccgtccaccggccctactccggcgagctggagctcgacgccgccccggtcggctacgcgcagaccctcgccgtgatggtcgccgaacgcttctccctgcacctggagaacgaccggctgcgccgcgccgacgtccgccgggccacctggatcaccttcctcgccgaggccagcgagctgctcgcccaatccctcgacgtcaacctcacgatggcgctgatcccgcagctcgtggtgccccggctcggccagtggtgcgcggtgcacaccacggacgcctggggccggctgcaactggccgcggccacccacgccgaggaggccacgctggcccacctgcacgcctcgctcgccgagtccggcccggagtcgatcctggcccggctggaggaggcgtcccggctcggcacccaggtgatgttcggcgccccgctggaaggcttcgcggtcccgctggtcgcccgcggctcgcggctcggcactctcgccgtcggccggcacgtcaagcaccggcacgacgccgacgaggtggcggtgctcgaggacgtcgcccggcgggccgccctggccatcgacaacgcccggatccacgacgaacgccgcaaggtcgcccgcaccctgcaggcctccctgctgccgccggcgctgccgcacgtcgagggcatcggcttcgccgccgaatacgtgccgaccggctccgaggtcggcggcgacttctacgacgtgatgccgttcggcaccgaccagtggctggtcgtcgtcggcgacgtctccggcaagggcgtccaggcggccaccgtgaccggcctggtccgcgacgtgatccggatcctggtcgacgacggcaagtcgctcaccgagatcctcgaccgggtcaatcgcacgctggtgcagcgtggcggcggccgctactgcaccctcgcgatggcctcggtcacccgccggcccgacggcggcctcggcgtctgcctgcacctggccgggcacgaccgggcggtgctggtccgatccgagggcaaggcgtccttcgtcggtgcgggcggcacggccctgggcctgctggaatcgatcacctcgccgaacgtggaggtcaccctcgggccggccgactcgctgatcttctacaccgacggcgtcaccgaacgccgccgcggtcgcgagctcttcggctccgcccggctccgcgaggccgccgcacccctggccggctatcccgcggatgcgatggcagcccgcctgcgctccacgacgatcaacttctcggtcgaggagccgcgcgacgacatcgccatcctggtcctccgcaacgacgcctgatttctgtcgtaccccggtggcagggtctcgggcatgacgacgcagtactacaccgcgaccacgatcgacggctacatcgccgacgagcaccactccctggactggctgttcgaggtcgacgacggcggcgacgcgaatccgttcggcgcgttcttcgccgatgtcggcgccttcgccatgggcgcgaccacgtacgagtgggtcctggcccacgagaacgtcgtcgccgagccggagaaatggctgtcgccctacggcgacaccccggcatggatcttcacgcaccgcgatctgccccgcgtccccggcgcgaaccttactttcgtacgcggtgacgtcaccgccgtgcaccgacagatggccgccgccgccggcgacaagaacatctggctcgtcggcggtggcgagctggtcgcctgcttcgccgacgcgggcctgctcgacgaactgatcctcggcgtcgccccggccaccctcggcgccggcgccccgctgctcccccgccgcctcaccgcgaaacggctgaccctgacgtcggtgagccggctcgggcagttcgccaatctgcgctactcggtcggcccaccggcctcctgatcgattcgccggtcaccgcgcggcagtgtgatcgatccgccggtgggcccaccgatctcctgatcgatctgccctttttgtcgccgtcggcgtggcatggtgttggcatggcgaagacgcagtactacaccgccaccagcatcgacggctacatcgccgacgagtcgaactcgctggactggctcttcgaggtggacgagggcaccgagaacccgttcggcgagttcttcgccggcgtcggcgcgttcgccatgggtgcgaccacctacgagtgggtgctgaagaacgacaatctgctggaggagccgcagaactggcacgacatgtacggtgacgtgccctgctgggtcttcacccaccgtgacctaccgccggtcccggacgccaacgtcttcatgatcagcggcgatgtccgccgggtccacgaggccatgctggtcgccgcccagggcaagaacgtctggctcgccggcggcggcaacctggtcgcccagttcgcccagcagcacctgctcgacgagatcatcctcggcatcgcgccggccgtcctcggcaccggcaccccgatgctccgccacaagatcggcgtcgacgagctgatcctcaccggtgtccgcgaggtcggccagttcgcctacctcacctacgccgtcggcgacgtcgcccgcatgggccgccatctcgccgccgaagcggccaccctgctccccgcccgtttctgaccaccgtttacgccgctgtcgggtgggagctgatcagaacaggtcgcgcggtgtagccatcggcagagcgacggcgagagccggcggggccgaaaccaccacgatcttgccactgcgggccatcagcacctggtccaccccgtcgacgatctcggccagccgccgcgccggcaggcccgccgggagcaccgcgtgcaccgtgccgaggccggccgaaccgcgcagcggcaccggcacgccgcaggcgtcccgcaacgcatacgtcaccgcctgcaggccctccggcggcaccgagatccgcaccgcgacgtcgccggccccgaacggataccgcccccaccagggcggcccgtgctcgaccacggccgcctcggggccccagacctggccgagtttcgccgcccgcccggccaccgacccggtgtcgccctcgatcagcacggcgaccgtgccctcggcggcgcccggcaggtccacctcgatcgcgctgggctccaggtcctgctcgaccgcctgctcgaccagctccgcgacgccggccggggtggtgaccgagcggccgacccagcggcgcgtctcgggcagcgggtgcagccgcagcaccgccgcggtgatcaccccgcggatgttggcgatgccgggccgcccgttctccccgtcggtttcgagctcggcgccgtcggcctcggcgtacatcacgctcagggtctgatccgccgggctgccgtagcggtgggcgaggggaccggcctcgttgacggcgagcatcccgccgaccgtggcgccgggtgagggcgggtcgacggccaggcgcttgccctgcagggcgagggcgacccggaccgcggccagcgacgtgcccgccgccacggtggcggtggcgccgtggtggtcccacatcccgttcagccgcccggtgtcgatgatcagatcgagtccggccggtggcgtaccccagtcgatcttgctgccggaaccgcgcgcgcggacgctgagcccgcctagctagctagccgcgacgtggccggcgcgctgcccgcccacccggtccaccgagcgcgccgggcgcgcgaacccggggccgcagatgtccacgagcgcatcgagaagggaatcagtcacgtccgaagcctccccagaccggagcgtagagctgaaggaagatcgtggagctgaagatcgtccactctggcacatcgtacacatgttcgaatgaccgaggtccaggtgtgtaacgaactcatcccggaccgatccaccggtaacgtggtgcgggtgacgaccgaatcgcccgccggcccaccgacggcccgcctggccccctccgagcgcacccatcacggcgacacggtcaccgatgagtacgcctggctcatggacaaagaggacccggcgacgatcgcctatctggaggcggagaacgcgtggaccgagacggccaccgcgcacctcgccgacctgcgcgaaaaggtattccaggagatcaagggccgcacccaggagaccgacctgtcggtgccgagccgcaagggcgggttctggtattacacccgcaccgaggagggcaagcagtacggcatccagtgccgtgtgccggtccgcccgggcgagaccgacccgccgatgggcgacgaccgtcccggcgaggaggtgctgctcgacggcaacctgctggccgaggggaaggatttcttcgcgctcggcacgttcgatgtcagcccggacggcaactggctggccttctcgaccgatttcgacggcgccgagcggttcaccctgcgggtcaaggacctgcgcaccggtgaggtgctggccgacgagatcccggacaccttctacggcagcgcctggtcggccgacggcagcgtgctcttctacatcacggtcgacgaggcgtggcgccccgaccgggtgcaccggcacttcgtcgggcagcccgccgaccgggacgcggtggtctatcacgagaccgacgagcggttctgggtcggcgtcgacctgacccgcagcgagaagttcatcgtgatcgacgcccaaagcaagatcacttcagaggtacgcgtgattccggccgacaccccggacgccgaacccgtggtgatcgccgagcgccggcagggtgtcgagtatcagatcgagcaccacggccaccggttcctgatcctgcacaaccgggacgccgaggacttcgcggtcgcctacacctcggtcgacgcccccggggactgggtcgagctgatcccgcaccagccgggcacccgcctggagtcggtcgacgcgttcgcccggcacatcgtgatctcgctgcgccgggacgggctgaccggcctgcgggtgatgggcgacggcagcaccgacgcgtacgacatggatttcccggagccgctctacagcgtcggcctcagcggcaacccggagtacgacacctccgcgatccggatcacctacacctcgctggtgaccccggattcggtgtacgacgtcgacctggtcacccgctcgatgacgctgcgcaagcagaagccggtgctcggcggttacgacccggccggctacgagcagttccgcgagtgggccaccgcaccggacggcacccgggtcccgatctcgatcgtggcccgccggggtgtcccccggaacggttccgccccggcggtcctctacggctacgggtcgtacgagcacagcatcgacccgtacttctcgatcgcccggctcagcatgctcgaccgcggtgtcgtcttcgcgatcgcgcacgtccgcggcggcggtgagatgggccgccggtggtacgaggacggcaagatgctggccaagcggaacaccttcaccgacttcgtcgcctgcgccgaggccctgatccgcaaccgctggaccagcgccgaccgcctggttgcgcgcggcggctcggccggcggcctgctgatgggcgcggtcgccaatctggccccggagtcgttcgccgggatcgtcgccgaggtcccgttcgtcgacccgctgacctcgatcctcgacccgtccctgccactcaccgtcaccgagtgggaggagtggggcaacccgctggagtcggccgaggtctatgcgtacatgaagtcgtacagcccgtacgagaacgtcgcgaagctgccgtactcgaagatcctcgcggtgaccagcctgaacgacacccgggtgctctatcacgagccggccaagtggatcgcccggctgcgcgcggtggtcccggacggcgagttcctgctgaagaccgagatgggcgccggtcacgccggcccgagcggccgctacgactcgtggaaggaagaggccttcgtcctcgcctggatcctcgacaccgtcggcgcctgaggacggttcaggattcggcgctcaggtcggtgagcatcggctcggttgaggtcggccgctcgggagcggccggcctcagcaggccgaggagcaggaacagcgcgaccacgtcggtgccgaggacgacggcgatgcagagcatcgggacgctcggcgcatggtgcgcctggagggcggccagtccggcggcgagcaccgcgaccacggtggcggcggtgaggaccgaaacggacatccggccacgcggatcggggctggtcacctccgggaccgtagtcggccgcgccgagtcgtagggggtacccggacggggtaaccgggtcgtgcgaaacccggcggcgaactggccaatgtcgccactagggtgtgtattcgctggtcagagcgcctgcggcgtgcaagtgtcggtgaggcggaatggggccgcccggggatcggagtattcacgtgacggggtgggacgaggggcagctggcggccgggttccggtcgatggtcatgttgtccgcgctggtggagcggggtggccggccggctccggtggcgccgaccgtgcggctgcggcccgccgagcggcagtacggctggttcccggccgacgtcgacggggacggccgccgggtcgtggtgatcaccagccagcggctcatcgtcggtgaccgggagtggtccctgcggtcgatcaccggggtggacagcgagccgcgcgactgcaccgtgtcgttgcggctgcgcggccggccggcgccgctggtgctcagcgggccgtgggtgccctggctgggcgtcgtgatctgcgccgagctctaccagccggtggcgcagcacggtgcgcaggtgccccggcagcgcggcctagtacacccagaccttggtcttcagcggcagcgcgtcgttgttccacatccagttcatcgcggcgatcgacacccgggcgcaaccgtgtgacgcggcgtagggcgggacactgttcgccccgtgcacggcgatcccgccgttgaagtatttgggccgccacagcagcccgagcggcgcgttccgccacccgtcgatctcccggcccacggtgaacctcccacggggggtgtcggccaggaaccgcccacccttctgctcgtagtaccggttcgatccggtcgaggtgttgaagatctgcgtgatccggccgccgtcgacgagcaggagcagttgccggttcaggtcgatctcgacgacccgccccttggtcgaccgcgccgccgggcgcaccccggcgtccagcgccttgagcgttttcggtccgacggtgccgtcgcggccgatgcccgccgctttctgcagcgcatagacggcctgctgagtgctgtcgccgaaggtgccgtccgccccgccgttccaatagcccaactcggtcagccgccgctgtaccgccaggacgtcaccgcccttggcgccgaccttgagtttccgcggcgccgccggcgccgacaccgacgggccgggcacgaccgaggcggacggctcggcggaggcgctgggcgcggtcgattgccgcgggggtacgccggtggcagtgcccggcacaccggcggtgccctgcgcgcccgtcgggccggtgccgcggccggagtcgcagccggcgatcagggtcagcgcggccaccgtccccagcgtggccgccaacagtctgcgcacgccgcgcctcccatcgatcgccttccaccattgtccacccgcccaggtgggtgatctccaagccggcgggccgagccgtgaaaaagagtcaagtactcttcggctatgtcgtggaaggcgagcgcccggcacggcgtgcgggaggcgcccggaggcttcgcgctcatccaggagctgctgaacactcgcgcggcgatgtcgtacggccctgacctgctcggagtcgtcgaggacgcccagtggtgggtgaccgacgcgctgggcacctggtcccggacgtccggcctgcccgcccccaccctgctgctgtccgccaccgacctgcggtcgctgcgccggctgcggtcggccttcgagcaggtggtgctcgccggggcgaaccaggagccgcccggcgccctgccccccgccgacgtcccggtcagcctggcgccggacgcggccggctgggtgcgggtggtgccgaccggccggggcacccgctggctggcgtccgcgctctgggccgaggcgctgctcgcccagcaggccggcctctggccgcggctcaagctctgccacaacacggtctgccgggccgcgttcttcgacacctcgcgcaacaacagcggcgtctggcacgacgtcagcacctgcggcaacacggcgaacctgcgcgctttccgggagcggcgccgcctgctcgggcacagcgaggagctgcaggtcgacgaccaccaccaccgctgaccccggacatcgccgggaaccattcgccggtcccgcgcgactatggatgcatggcgtgtgaacggtggcgcgagatgctgtccgcgcagttggacggcgaggacgatccggccctgcgcccgctggtcgacgagcacgtgtccggctgcgcgggctgccgggcgtggctggatgcggccgcggcggtcaaccggatgacgagcaccgggcggatgcccgacgtgccggatctcagcgcgtcgatcctggccgccctgccgccctcggccccggcccgaccggccccggcccggtggtggcggcgactcccggtggcggcgctgctctacgtgtcgctcgcgctggtcggcgcggtccagatcatcctggggctggcgcagatcggcggtgactcggccgccgggcacgtgcacctgggcctgtccgcgaccccgggccacctgtggaacgagtcggccgcctggaacgccgcgatcggcgccggatatctcttcatcgcgctgcggcggacccgcccggtcggcctggtgccgatgctcaccgcgttcgtcgcgatgctgctgctgctctcgctcaacgatctgaccggcggccgggtggacgtcgcccggctggtcgggcacggcttcgtgatcgtcggctatctgctggtggtggtgctctcccggggtgccggcgacaccgcgcggccgcccggcgcacgggccggtgcgggctggcgcctgaccggcgcggccgaggacgagcccgggatcgcggcgccgcaccgccccggcctgcggctggtcccgccgaccggcccgctcaccgcccaccacgacgatcagcaggccgcgtgacaggacctcgccggaaaccggaacgccgacttcggtggccggcctcgcccgacgggtacacgggccgtcgcgccggcctcaccggggcggtcgcacggacagctcccgccactcgtcgggcccgttgagcagggcgcgcaccatgtcgagggcggcgtcctccgagtcgtactcgaagaagtgggacgtgccgtcggagcccccggcacgctgctcgacataccactggtccccattggtacggaggtagacgtccttccgggcgagacgtccccatttaccgttccaccagtgcttacgctgctccatcccggcactgtatcgaacatttgttcgaaccgtgccgggagggccgatcttttcaccgacagcgcagtggggcgacccccggcaccgacgcggcgatcatcgaagtcagcgcggcgggtcctggcgacgctgcagcacctcgtccaccgcgcttccgtacacctgtccctgggtgttgccgcgcccggcggccgcctgcgccaccagcgcgtcacggatctcggtgagcagcttgacctcttcgctggggctcttcggcggcggctcctcgccccgccggcgccgctcggcgagcacgttgagcgggtagacgacgaggaagtagaggaccgcggcggtcagcaggaacgtgatggccgagttgatgaaggtcgcgtagtcgaacttgacgccgcggatcttgaacgaacccgcatccatcccgttaccgccactgatcacctggatgagcggcttcaggaagccgttcgtcaggctggtcaccacggcggtgaaagcggaaccgatgaccacaccgacggcaaggtcgacgacgttgccgcgcatgatgaagtctttgaagccttggaacatcttcttcacgggcactcctgggggccgaagctaatcccggccacagtttcccgtcaccggtcggcgacaaactacgccgaccggccccgcgaaggcgacgagactcgcgtcagtcgagcgcgggttcctcagcggtgaccgcctcgtcgaccgtcggataggtgtgcagcacctcgaccagcccgctgacctcgaggatgcgcagcaccccccgctgcggcgcggccagccgcaccgtcccgccggcgtcgtcggtgctgttcttcgcccggacgaaaacggacagcccggtggagtcacagaacgagacctcggccaggtcgaagaccagcctggtccggcccttctccagcagatcactgatctggtcctgcaactgcggcgcggtggccatgtcgagctcaccggccaccgacacgacgaccatgtcaccgcgttgttcggtctgcaccgtcaaggacattcgggaccctcctgttattgctgaacggtactccacgtaccgggacgtcgcgcgccgtgggaggcaggccttgaccttgtccattagttggtctacagcaattaacggacaccctgatggtaaagtccggccgttgcgcacggatcgtgtggtgggggaggcagcggtggcgctgagtccggatgagtcgggtcgcttcgctgacctgctcaaagagcacgccgacgggctggtcgcccgctgggcggtgctggtcggggtcagcttgcagggccgcatgagccggcccgagttggagcggcagaccagggacttgcataagggtttccagcaggcgctggccgccggcgcgcaggacctcggcgacgaggcggccggcgagctgcgggcccagctgagcgagctgtccagcagccgggcccggcaggggttctcggcgaccgagacggcggtcagcgtgttcgcgctcaaggacgcggtcctcgaggtgctcggtgatgccggtgacgacgcgcacaccctgcgcggctacgtggcgttctcggcgttcgtggaccgggccgccctgttcaccttcgacgcctatgtgcgggtccgcgagtcgctgatcgccgatcaggccgagcagctgctggagctgtccaccccggtggtcaagctgtgggagggtgtggtcgccgtcccgctggtcggcacgctggactcggcccgcgcccaggtggtgatggagcggctgctgcagactctggtcgacaccggctcgccgtacgcgatcatcgacatcaccggtgtcccggcggtcgacacccaggtggcccagcacatcctgaagacggtggtggccgcccggctgatgggcgccgactgcatcatctccggcatccgcccgcagatcgcgcagaccatcgtggcgctcggcatcgagttcggtgacatcgccaccaagtcctcgctggccgacgcgctgcgttacgtgctgggccgcaacagctacaaggtcgtgacggccaagcggacggagcgctgacgtggaacgcgtcccggtcctgaagatcggcgacatcctcctggtctccatccagatcgacatggaggaccagaccgccctgcagctgcaggaggatctggccgagaggatcgtggccaccggctgccacggtgtgatcatcgacatcagcgcgctggacatcgtcgactcgttcgtcggccgcaccctggccaccatcgcctcggtctcccgggtgctggacgccgagacggtcgtggtcggcatgcgtccggcggtcgcgatcaccctggtcgagctgggcctgtcactgccggggatccggacggcgctcaacgtcgagctggccatcgagatgctggcccagagccgggccgtgaccatgggcgaattcgacgacgacgaggacgaggacgaagccgaccagacggcggtaaccgcgccgtgaacgaggagagccggcggatcccggtcaccaccgaccaggacgtggtgcgtgtccggcagctcgtgcgcaccgtctccgtcgaggccaagctctccctggtcgaccagaccaagctggtcaccgcggccagcgagctggcccgcaacaccctggtctacggcggtggcggcgaggtcgaggtgagccgggtgcgcaacgatctgcgggccggcatccggatcgttttctccgaccaggggccgggtatcgccgatctcgacctggccctgaccgacggctacaccaccggcggcgggctcggcctcgggctgagcggcgcccgccggctggtcgacgagttcagcatcgaaaccgcagtgggcgagggtacgaccatcaccgtgaccaagtggtgccgatgactggaggaacggtggctctcgtacccgaaggacttctcgacgagggagtctggttccgggtggaggccgccgggactgccgccgccgtccgccgcgccgcggaacgtctcgccgccgagctggccatgccggagcgccggatcgcggatctgtcgatcgtcgccgccgagatggccggaaatctggtcaagcacgcccaccagggcaccattctggtccgcacggtccgcaccgcggagcaggccggcgtggagctgatcgcgatcgacagcggcccggggatgtccgacgtgccgcacgcgttcggcgacggccattccaccgccggcacgctgggcatcgggctgggagcgatccagcggcaggccggccgctgggatctgcattcggtcccgggccggggcacggtgctggccgtgcaggtctggccgggagtgacgccaccgccggcctgggcgtccgggctgacccggccgatcaccggggagacggtgtccggcgacgcggtggcgatccgcgagatggacggccgccggcagatgctggtctgcgacggactggggcacggcgggctggccgcggccgcctcccgcgaggcggtccgggtgttccgggagacgccggcgacgtcaccggccgcgatcgtcgaggccttgcaccgggcgatgggacacacccgcggcgcggcgctggccgtcgccgacctggatccggcgacccgtcaggcgcggtatgcggggctcggcaacatcgccggcaccatcttcagcttcgagggcacccggcgcggcatgatctcgatgcccggcatcgccggtcaccagcgccggcagatccgggaatacgagtatccgctcccgcccgacgggttcgtgctgatgcattcggacggcgtggtcgaccgctggaacccgacggactatcccggtctgctcacccggtcgccggagttgatcgcggcgaccgtgctgcgtgacgccggaacccgccgcgacgacgccggcgttctcgtggcccggctgccatgaccgcgagcgagccgctgatgcgcatgcgcctgcgggtcgagcaggacatcttcgcggtccggcagttcggtcgggaggtggctcgcgcggtcgggatggagtcgcaggaccagacccggctggcgacggcactcagcgaggtgggccgggtgttgctggccgccggcacccacgcggacgtgacgttcaccgtggagccgtacggggtaccaagtctccaggtgacaatggcacattcggctccggactcggtgtcctggctgactggacagttgcagcaggtcggccgcctggtcgacacgatggaggtcgacgatggcggtcccggtacgacgattcggatggcgcggcgcctgccggtcggcgcgccgttcctgacccccgaccggatggacgagatccgcgcccgcctggcccagcatgtgccgggcaccccgctggacgagctgggtgtgcagaaccagcagctgatcaccgccctcaacgaggtgcgggcgcagcgtgacgagctggcccggctgaacgccgagctggaggagacgaaccgcggcgtgatggcgctctaccaccagctctccgacgagctggaggagacgaaccgcggcgtggtcgcgctctacgccgagctggacgagaaatccgtgcagctgcgggcggcgagcgaggcgaagagccggttcctggcgaatgtcagccatgagctgcgcgccccggtgaccgcgatcatcgggctgggccggctgatcaccgactcctcctcggacgacctcaccgaggagcagagccgtcagatcgagctgatccgcacctccgccagtgacctgctcaccctggtcaacggcctgctcgacctggccaaggcggaggccggccggatcgagcctaactggtccgcggtcgatctgaaggcggtgttcggtcagctccggggcaccctgcgaccgctggccacccggcccgaggtgcggttcgtggtggacgagccggctgtgccgaccatccactccgacgaggtgctgctcgcccaggtgctgcgcaacctgctgaccaacgcgctgaagttcaccgagaccggcacagtgcggctgagcgtgcggcgcaccggcgacgacgcggagttcaccgtctcggacaccggcaccggtatcccccacgagctgcaggaacgcatcttcgaggagttctatcaggtgcccgggagcaagccggtcagcggccgcggcaccggtctgggcctgccgtacgcccggcgtctggccgggatcctgggtggtggcctgcgggtcgactccacccccggcgagggcagcgtcttcaccctgcagctgccgatcgggccggcatgaccgagctcgcccgcgtcgagagactcgtccagggccatgtgaaagccaccgttctcgtcgtcgacgacagcgccaccaagcgttacctgctggtcagctggctgacccgggccggtttcacggtgatcgaggcggagaccggcggcgaggcgctgcgcaagctcggcgaggacctggtcgaggccgacctggtggtgctggacgtgaagctgcccgacatgagcggtttcgaggtctgcgagcggatcaagaccgatcagcggtacggcgttctcccggtcatccacgtgtccgcgcacgccgtggacgtcaacgaccgtacccagggcctgaaccggggcgcggacgcctacctggtcgagccgatcgagccggacgagctgatcgcgaccgtgcaggcggtgctccgctactaccgggcccggcagcgggccgagctgctcgccgcgcgcctggtccggctggccgagaccaccctcgcgatcaactcggcgtcgaccctgccggcgctgctggaggcggccgcggtgggtgcggcggacatcttcggcgggccggtggtggtggtcgccgagacgtcggagggggagagcctggccgcggcggggccgcccctgggcgtacgaaagtgggctgttccgcatcatcgggtggcggtcggttcgctggtccgcaccgatgaaccggccgactgggacgtcgtcgactggccggcgggcgaatccgtcgcggtggccgcggcccggctgcggatcgaccgcccgccggtgtacctggccgtctcgggcagcacgcagacgcccggtttcccggtgttgcggcagctctcccaggcggtcgcggccgccgtcgaggcgcagcgctcgttcgacgaggagcaccggatcgcggtcaccctgcagcgcagcctgctgcagtcgacgctgccccgggtgcccggcgtcgagatggccgtgcggtacgagccggccggcgcgcagaccgaggtcggcggcgacttctacgagctcaccgtgctggacggcaagctgctggtggcgatcggcgacgtggccggccactcgttgcacgccgccacggtgatggccgaggtccggcacgcggtccgggcgtacgcggtggagggtcactccccgggcgcggtgctcggcctgacgaaccgtttcatgcgcaccgtgctgccggccgactcggccacgctgtgcctgttcaccctggacccggcgaccggccggatccggatggcctcggccggtcacctgcccccgttgctgcacgtcgacggcgaggtccgcttcctgtccccgcgcggcgcgctgctcggtctggacgccccggaacgcaccgagctggagctggagctacccccgggcggcacgctggtgctctacaccgacggtctgatcgaacgccgcgacgccgacatcgacgagggcctgcgggccctggccgcctgcgccgccgatgtcgagccggatctggacgcgttctgcagccgtctcctgacccgcctgggcgggtcaggagaccaggccgacgacatcgcggtcgtcgcgctgcgccgcgcttgataccggctagaacagaccggcgtacgtctggtagccgctgccgatccgctccgccgccccgaacgtgccggcgtcggtcccgaggaagcggtacaacttaccgctcgcatcccgggccagcagatcgttgagaccgtccagattgaggtcgccgatgccgagcacgacgttgtacgccttgaatcccgacccgattcgggtgctcgccccgaaggtgcccgtgccggtcccgtactgcgcgtacagcccgcccctgccgtcgatcagcagcaggtcggcgtggccgtccccgtcgacgtctcccgggccgattagacggaagccctggtaggagccgctgagcgggacgccgttggtgaagccgcccgtgccgttgccggcataccgcaggaccttgccggtcctcgcgtcccgggccagcaggtcggtgatcccgtccccggtcacgtcgcccgtggtgatcagcgtgtcgaaccggttccaaccggtgccgatcttgaccaccctgttccggtcggagccgaagtagtcctcgccgaagcccaggtgggcccagagcaccccgttgccggtgcgggccagcacgtcgttgttccggtcgccgttgatgtcgccgtacgggacgagcgcggagatctggctgttcccggtgccgaggtcccagaattcggagatgtactggtagaccagcgagcggcgatcggcgtacgcgtgccaccacgcgccgttgccctgcgggtccaccgacagcatggagggcatgccgtccaggccgtaactgtggagtctcgggcgctccccgtcgaggtagaccggcgatcccgcgatgtcatggccgacgccgtcgggggtggtcaccaccaggttgacgcggtaccgcccggcgggcgccggcgtcttgtcggccaggtatccgtcccaggcgagccggacctcgccggtgctcgccccgccgttgagcgtcatgacgaccttgccggagtgcagttcggcgatctccgcgcgccacgaggcgaccgggcggctcaacgtgtactgccggacccacgggcggtcgtggtcgtggtagacgacgtcggccgaggtggtgctccggatcaccgtcggcggccgctcgaccaccgccgggtcgatcacgtgggcggcaccggccgcgtccacgtaggcgacgttcccgctgtacttgtcgacggcccaggtgatgttccggtcgtcggccggggtgccccggtccagggtgccgaggatcgcggtcttcggcgcgccgcgcagggtcacgtcgtacgagatgagccggccggtcgccgcgtcgtgccggaccgcgtagccgtcgccgagcagataccgtccggccggcagcggatggttgatccgctgcggcacgtcgtagacgccggccgggccggcgacgccgcacgaccagaagacgaaccggcccgcggcctgcagctcggacggggtgcaggcggcgccgatcgagatcggggccgcggtcttcccggtggtcaggtccttggaccggatctggccggcgccggcggtccacagcgtggcgtagtcgagggccgccgcggtcaccgcccgttcggtcctggcatccgggttggcggtcggaatcacgtactgcttcgccggcgaggtggtgttcacgatcgcgtagtcgtcggagacgtcgaccaggctgccgccgcctccggccagtacgaggctgaacccgccgctggcgccgtcggcgaaccggaccgtggtggtggtctcggtggagctggtccagccggtgccgtatcggttgccgtccatggtgcgcacacaggtcacgtcggccgcgcacgaggtcacaccggtcatcgtcgggccggtcaccggcagcccggtgagaccggggatgagctcatggttgctgaagtcgtagaccgggctctcgaacggccgggcgccggcccggacgtgccgcagctgcccccggctgatcgtgatcccggcgctgaagttcgtccgcacctcggacatgaccggctgcaccccgtccgcggtgatccgctgcaccgcccagtcggcagcgccggagccgcccaccaggagggcgccgcccggagccgtggccatcgcgtacgggttgctctggctcatcggcagaacggtccgctcactgccgtccgcggagatgagccgagccggcgcccggttgtccgcggccgaagcccggaccagcatgtcgccgccgaccagggtcaggtacggcacggagggcaccgtgatgaccgccgggtcggtggccgtgccggccgtgatcgccgcgcgggagaacacccggacggtgttcccgccgcggaaaccgaggtgggtggcggagagcaggatctggttgaccgtcccgaaggtgaactgcgggagcagcgaaaccttgccgctggtgaagtccagcagcccgagccgctgccatttcacgccgtcggtggtaccggagaagctcaccaggaaggtggtcgagtcgaagaccgtgcccgacccgccggaaacggcggtaccgtccggcacaccggtgatcggaatcgtcgtgtacgtaccgtcggcggcgaacttccgcagctccagtgggcctgccgtgccgagccggaccagcatcgtcccggccgagtaggcgagcttggtgccgtcggtcggcagggtcgggttcgaccaggtgccggcggccgcgtcgaagatggtcagcgacctgtcgtcgctgtgcccggcgacgtcggtcttcacccagatcctgtcgccaccggcccaggccagcgctggtgccgtgaggccggccagctcggtgacgactcgggtcgagccgtccgcgtaacgggtccacagccaggtcgacgtggcccaggacgagccgccgtactggtgcaggaagccggtctccccggccaggacgagcgagtcgaccgggaagtcggtgcgcgtcgggtaggccgggacgaccgacacctcggacggttgcggcagcgccacggtggcgtgcgccggggtgaccgggagtgccgtgaggccggcggcggaaagggcgatgcagccggcggcagcgaggccgcgtcgagccgcagtggacatgggttcatcccccgatattgatcttgagacaagcatgtggacgaggcctccgcccgcgcgactcacctcgacgcggccgcggagacgttcaccgtcgcggtcgagggggtaccggacacaccgcccgcgacggccgcgaaggtgagctggtacctgccggcggccgccggcctcccgtccgcccgcaggccgtcccaggtgacctgggcggtccggtcggccggcccgccggtgagggtgcgcacgacaacgccgttctgggtgatcgtcgccgtccagacgtcgaccggccggttcagcgtgaacgaccacgacgagctctgaccggcggccgggttcaggttgccggcgggccggccgacgacggccggggcggaccgggcgacgccggtgtcgatcacgtggatggtgttcgcggcgtcgacgtaggcgacgtcgccgctgtacttgtcgacggcccaggtgatgttccggtcgtcggcgagggtgccgcgggggatggtgccgagggtggcgctgcggcccagggtgccgcgcagacgcagatcgatccggatcagctttccggtcgccgcgtcgtgccggaccagataaccgtcgccgagcaggtactgcgcgggcgggacctgccggctggtcttggtgaccccgtcgtagacgccggccgggccggcggtgccgcagctccagtacacgtaccggtcggtggcctgcagctcggacggggtgcaggcggcaccgatggggatcgccggcgagctgacccgggtggtcacgttcgttggctggatcttgccggggagcccggtccacagggtgttgaaccagagtgcggcgcccgtgatcggccgctggacgacatccgtgtcgccggcaccggcgcgcaggatcacctgaacgttcgcccgcgggaaatcggagaccacatattccagcccggcgtcgacgaccgcggcatcgttgacggtcagtcccgagatgtcggtgtcgacagaggggcgagccaccgaatccatcgtcaacactgaataaccggccgcgaacgacgtgccgtaccggttgccgtccacggtccggatgcagaaggcggccggttggcacaggaacgcgccgacccggcccccgtccaccggcacctgccggtcgattccctcgctcagatggtgattgatcagatgaaggaaggtgtattggtcgccggcccaggtcaccgtctgcacccggcgcaccatcccctgcgagatggtcaccccggtggtgccggccttggcgctgaggtccgcgagccgggtgtccccggcggcggtgatccggtggattccccagtcaccgctgtcggccccgcccacgaccacggccccgtcctcggcctgcgtcaggctgccgctgccgggctgggactgcgcgaacagcgtgcggtgcgatccgtcggcggagtagcgatagacggccggcgccacgccgccgccccggggctcggggctggcgagcacgtcgttgccggccagcgccaggcggtactgctgggtgaggggcaggtggatcggctcggggctcgcgggtgcggtgccgttcagcaccgcggcacggtcgaagatctcggcagtcccggtgtccgccccttcgtcgagcagcgcgacgcggccggccgagagcaggacggacgaggcgacggtggcccggtttccgccgaacggcgagaccttcccggacgccaggtccagcaggccgaactgccagccgaaggtgttcggcttgcccccgaagcggatcaccatgccggtgctgtcgccgcggaccgcaaggatcgacgcggtgccggccggtattccggtcatcgggacgtcgatcgacgagccgtcgacggcgaaatggcgcagcgccggggtggccgacgacgagcgcacataccaggtgtcaccgtagacggctctgaagtcggccgtcctgggccggtgctgccaggtcatggtgccgaggtcgagggtgctcaccgtgtcggcttcggagtgcccgtcgacatccgcgtccacgtacaccgtgtcaccaccggcggacacgaagtcgccgggatacagccggccgagggtggtcaccgtcgtggtggtgtggtcggcgtacgtcgtccactgccacgtgccgcccccgttcgcgcgggagtgcagatagccggtgcggccggcgaacgccacgtggtcttcccggtactcgaacggcgggtcggcgggaatcgtcgcgacctcgtgcggattcgacagcggcaccgtcgcggacgccggggcggcgacggagattccggtgagggcgagaagagaacagcaggtggcagcaaggccacgccgcgtcatgggcatggttcagtcccccgtagtagtgcgcgcagcttaaagatcgatgtctgtccggcgcaagaacgacttgaccacagctattcgctcagtgaatagttgcgtcatgtccaccgctcacgtgctcctgggtctgctcgccgacgggccacggcacggctatgagctgaagcgtgcgcacgacgaccgcctccccctggcgaaaccgctcgccttcggccaggtctacgccaccctgggccgcctggagcgggacggcctggtcgtccgctccgggcaggatcaggagtccggcccggagcgcacctccttcgagctgaccagcctcgggcgggaccgtctcgccgcctggctcaccgaggtcgagccgcccgcgccccatgtgaccagcaccctcttcagcaaggtggtcgtcgccctactggcggccggcgccgaccgggcgcgcgactacctggtcgcccagcgcgccgcccacatggcccggatgcgcgagctgaccagcacgaagaccatgcccggcgcctccgtcggcgacatcgtcgccgccgattacgccatcgggcatctcgatgccgacctgcgctggctgcagaccaccctggcccgggtcgccgacctgcacaaggaagtgacagcgtgagcacaccactgttgaccggcaccgggatcgtcaagagttacggcgccacaccggcgctgcgcggcgtggacgtcaccgtcggcgccggggagatcgtcgcgatcaccgggccgagcggctgcggcaagtcgacgctgctgcactgcctggccggcatcatccggccggacgcgggctcggtcgtctaccgcgatcaggatctgaccctctggtcggaggcgtcccggtcccggctgcggcgcaccgagttcggcgtgctgttccagttcggccaactggtaccggagctgaccgcggccgagaacgtcgcgctcccgctgcttctcgccggttcggggcggcgagaggcgcggggcgcggcgctcggctggctggaccggttcggggtggcggaggtggccgacaagcggcccggcgcgatgtccggcggccagcagcaacggtgcgctgcggcccgggcgctggtcaccgagccggcggtgatcttcgcggacgagccgaccggtgcgctcgaccagctcagcggggagcaggtgatggcggcgatggtgcaggtggtgcgggagcagggcagcgcggtcgtgctggtcacccacgaggcgccgatcgcggcgtacgccgatcgggagatcgtcctgcgcgacggcgccgtggacgccagcggcatcgggatcttcggatgagggccggcacgctggtccggctgagtctcgccggcaaccgcaccgaccggctgcgcaccgcgctcaccgcgggcagtggggcgctggccgcgctggccctgctggccgccgccacggtcgccgcgatccacggcggcgagtgggtatacgacccggccgatccggcccgccggtccaacctgtcgccgggctccagccagtactcgagtgccctactcgccgagcacggcctgcgtccgggcgtgatcttcgcgctggtcatgctggccctgccggtgttggccctggccgggcagtgcatccggctgggcgccccggcccgggatcggcggctcgccgcgctccggctggccggcgccaccccgggggagacggcgctggtcgccggcgccgagaccgcggccgccgggctgctcggctcgctcgccggctacggcctcttcctgctgctgcgcgtcctgctgaaccggcgcaccgcggacggcaagctgctcctgcccaccgatgtgctgcccggcccggtcgcgaccgtcctggtgctgctgctggtcccggtgctgtccgggctgatcggcacgctgctgatgcgccgcgtggtggtcaccccgctcggcgtggtccggcagatccgcgacgacggcccgcggccctggccgggcgtgctgatcgcggtgggtctcgtgctgttcgcgccgcgcaccctgcacctgatcccgccgggctggcatgtgccggactggacgccgctggtgatgatgggcgccagcgtgctgctggtggtgatcggcgtggtgctcggcaccggctggatctcgtacaccaccggtcgcctgctccgccggttcggtcgcggcccggtgaccctgctggccggagcccgcctgatggccgacccgtggaacggcagccgcaccctcggcgccctgctcgccgcggtcgtcttcggcgccggcacgctgggttaccgtgccgacctggccgccgacttcgccgcgcgggagcggttcgaccagctcaccgatccgcagtacggccggtacggcccggctttcgacaccggcttctacttcggggccatccgcctgatcctggtcgcggtggtgctggccctggtggtcgcctcggccggcatcctggtcaccttcgccgagggcatcaccgcccggcgccgcacgttcgccgcgatgaccgccggcggggtgccccgcggcaagctcggcgcgatgctgttctggcacacgttcgctccgctgctgccggcgctgctactggccctgaccgcgggggtgtcgctgatccgcacgatgcgcaccgaggtcgacgtgtcggagcccggcccggccggcgatctcgcggtggtgcacatgccgatcccgctccccctggcccagctgaccctcctgggtgccgccaccctggccaccatgctcctggtgaccggcgccggtctgctggtgctgcgcgccggcaccgatctggaggagttgcgcgcgggatgacgcccccggatccgggtagtccaccggtcatgagactgctgaccgccgccgtcgtgatcggactcggtgtccgcgtcgtgcgctcgcgccaccggcgattcctgcaccccgcgggtcgttcgttcgccggcacgctggagatctggggtggcgccgagccgctcggtgccaccctgctcgacaccccggccgtgcacgacgtgacggtccgcgtctccaagggcgccggcacgaggggcgcccgcgtcgacatccgtggcgtcgcggtccgggtcggcccggctgacctgctgctctcctcgaccggccggaccgccctgacgaagcggcttccggttccccgactgagtttcgacacggtgtacggcgcgatcaccccgtaccggactggcacccgcaagctctatctggaggcggtcccggatccggacgcccgcccgctgggccgggcgctctcctcgatcccggcgggcgccgcgctgctgctgcgcgccgacgaccggacggtcggccgggtggcgctgcggcacgccctgcccgaagcgaccgatgcggcgctggccttcgatccgatccgcaacgccacacccgacctgcaccccaccggcctcatccacggttcccgggcgctggcctaccgcctcagccagcgctggcgcggggccaccccgccggccacggatcccgcggcgctggcccgcaccgtcacccaccactgatcggcgtcactgcggcaggaactcccggagctcggatcagcaccggtcgccgggctggggcaccggcgccggcgccggcgccggctgagatcgtgtgtctctgcgatcgccgttccggtgcgcggatagcatgcgaagcacaccgttcgtacttgatgaaggagatccgccgtgtctgcaccccttactcccgtcgtggccgaccccgtcgtcgtcccggccgggacgactagctagctagccccgatgagatcgggtcgggtctgccggtcttccacccgaagggtggggtgatcaagcgggagatggaggactacgtccgggcccggcacatcgaggagggcttccagtatgtggggaccccgcacatcaccaaagagggactgttccacacctcgggacatctgccgtactacaaggacacgatgttcccgccgctgcagatggagggcgcggactactacctcaaggcgatgaactgcccgatgcacaacctgatcttcaagtcgcgcgggcggtcgtatcgtgagctgccgctgcggctgttcgagttcggctcggtctaccgctacgagaagtccggcgtggtgcacggcctgacccgggtgcgcgggttcgcccaggacgactcccactcctatgtcaccgccgagggcgccgccgacgaggtccggcacctgctgaacttcgtgctgtcgctgctgcgcgacttcgggatggacgacttctacctggagctgtcgacccgcgacccgaagagcgacaagttcatcggctcggacgagcagtgggcggtggccaccaaggtcctggaggacgtctgcatcgagtccgggctcgacctggtgcccgacccgggcggcgcggcgttctacggtccgaaggtgtcggtgcaggtcaaggacgcgatcggccggacctggcagatgtcgaccattcagtacgacttcagccagccggccggcttcggcctggagtaccaggcggcggacggctcgcgtcaggagccggtgatgatccactcggcgaagttcggctcgatcgagcggttcttcggcgtgctcaccgagcactacgcgggtgcgttcccggcctggctggcgccggtgcaggtggtcggcatcccgatccgcgacgaccacgccgactacctgtcgtcgttcgtggagcgcctgcgccgggagggcatccgggccgaggtcgactactcgtcggaccggatgcagaagaagatccgcaccgcccagcagcagaagatcccgttcatggcgatcgccggcgacgacgacgtgaacggcggcaccgtgtcgttccgctaccgggacggctcacagcgcaacggcgtgacgctcgacgaggccgtggcgcacgtggccgaggtcgtccgctcccgcgtgaacaccggtccgtcagcagcctgacctgcaatttcccactaagggcggccgcttcggcgggcgcccttttcggtatcccctaacgcctgtccggaaccccttcgtcggccccgcggtcgatcatcggctggttttcttgtcacatcgagttaaaccgattgctacgaaaggggactcccatgatccgcgaagagagccgtgacctcgccgacctgaccttcatggtctgctgagcgatccctcaggtgtggggtgggccggcccgcgcggccggtccacccaccggacccacggagtggacgaactgtgaacctgccctacgcacgcgtgccggggaacccgccgttcgccgcggcccgtgtcctcgacgtcgccgccctgcgggacatgtggctcccgtggatctccatggaggcggcccccacgacccacgtcgtcgcccgcaactcgtacctgacctggacgtacgtctgccgcaccgattccgctgacatcttcgcccggccgtggctgtcgatgtacgcctccggtggcctgcgcgccttcgtcctggaccaggcccgcgccgtggaccacctccagcaggaggaatcctgcccggccgagatgaaggaactgcgcgacacctggctcggctggttgcacggcgacgacgtgctgcgccggctgcaggccaccgcgctgctcggcacgctcaccacgactctgccgctgatcggcaccgacgacccggatccggccgtcgccgacccggtgcaccagcactggtgctacgagcgggccaaggcgatccgggcacgcgacctcgggcacgccccgagcgccgccaccatggagtacctggccgaatccgcgatcgagccggccatccggatgctcgcgctggtccacctgatcacctacgggatccgcttcggcatggagtccgaccgggtcggcggatgggtcgagcaggccggcgccgtcgtgccggccctggccgagcacccgcactggctgggcctgacggtggagaaccgcctccagcgggtgctggccctgcggtacgcccggcagaacgacgacgcggcggtccggcggaccctggcgcgggccgtcgagctggaccgagcgctggccgcctacgcggacgactcgatcctgctccgcagcctgtccaccgagatacaccggctcctgctggacgtgcaggtgcgctacgagaccaagtgcggcaccctggccaccgccgcgccgatgatcgccgaactggaccgtatcgaaccacactatccggacagccggtccgcgatcggcgcgctgtacgcggccaacgacctgccggaccgggccgcggcacagttcgagcaggccgccgcgggcggctcggtcctcggtgcgatcgccgccttccgggccttcgagtgccaccggctggccggcgaccgggacggcgccgaacggtcactgctgctgctggccgacctggaccccgcggccgacatcgggcggtacacatgatgaccgtcctgacgagttggtggcgggccaacctgcccgccgacccggccgggcggcgcttcgtcgccggctccctggtcgacaacctgggcagcggcgtccgcgacgtcatcctgccgctgttcctggtgcagatcgccgggctgccggtcgccgaggtcggcaccggcctgctggtctccggactgatcgggctgctgggcgcgccgttcgccggccgcgccgccgatcgggccggcgccaagaccgccctgaccctcggctgcacgctgaacgcggtggtctcctgcctgctgatctcgatccactcgctggcggcgatgtgcctgctcctcgcggtgtcgcgggtggccacccagttctcccgcgtcggccggctgaccatcctggcgcacgtggccggcgagcggcgcaacacgctgcgcgcccagatcaacatcttcaacaacgtgggtgtcgcggtcggcatgggcgtcagcgcgaccgcgctcaccctcggcacccgctcggcctacctggccggcttcctgctcgacgcggtgacgttcctgatcgcggtggcgatccagctgccgatccgggtggacgcgatcgccggcccggccgtgacaccgccgcgggcgccggcgccgtggcgacatctgttcaccgatcaccggtacgccgtggcgaccgcgttgaacgggctgctctgcctgcaccaggcgatcctgttcctgggcattcccctgtggatcgccgccacccacctggtgccgcggccggtcaccgcggtgctgttcctgctcaacctgaccctggtcatcgccctgcaggtccggttctccgccccggtccgcggtctcgcgccggccgcgcggtcgtggcgccggtcggcgaccggtgtcgccggggcctgcgcgctcatggtggccgccacccgggtggactcgaccgcggtccgggtcgccctggtggtcggggcgggcgccctgctcacgctgggcgagctgtgctactcagccgccgagacggagatctccaccgtcctggcgccggccgagcaccgcggcctctaccagggagtcttcgtcctgggccgggacgccgcgcagaccgccgggccgctcgtggccgcgctgttctgcgtgtcgttgcacgcctgggggtgggggctgttgctggccggcttcgcgctcttcgccgtgctggcgccggccgcggtccggcaccccgagccggtcagcgtctaggaggacccgatgatccagcagctggcccccggcaccgtctcgttcgcgcggttcgacgaggccgagtaccgccgcgtcctcgacgagcacggcttcgtccgagccgtcgacgtgccggacggcttcgaccacgccgcgttcctgagccggttcggccggttccgtcccgggccgtccggcaaggtgatcgacgacatcgtcgccgaacccggcatggacgacgtctactacggctccaaccgtcgggcgctgctgccgcacaccgaggggtacgagttcgccggcctgccgccgcgctacctcgccctctggtgccggaccccggccgccggcgacggcggccagaccacaatcttcgacagccgtccggtcctggccgggctgtccgcggccgagcgggacttcctgcggcggaccaccttcgacttcgtctccagcgagggcctgcgccggcacgggctgggccagaccaaccggcatcccatgctggagaccgtggacggcatcgagctgctccgcttctcctgcaacaacgtccggctgggcgagcgggacgggccggcccggtcgctgatccggcgggtgctggacgcctgggacgacgggcacgtcgccgtgacgtacgcccgcaacgatcttctgcacttcgacaactggcgggtgctgcactcgcgcaacgcgtacaccgatccgcggcgccatctgcgccggatacagctcgaccaagtctgaggagggatgacgtgccggatctcgctgaggcactcgacgacatcggcgaactcaagcgccggtaccgggccgagggggccgtcttcgtcgacggttcgcggctggctccggtgctgcgcggcctcggggcgacccgggccgacctcgaccggctccgccgcgtcggtgaccgcctgcccgaggacccgaccctgccgttccgcaggtcacgcaacgggcggttctgctacgacgccgaggccggccgcgcataccggctcgaattccagccgttcgtgctctcccaggaggaggacttcgtccggcacgactccggcatggtccgcaagttcgccgagatcgggccggacctgcaggacaacacggccgcacaggccctgatgacgttccagttcctgatgatcggcgacgtcgacatccgcccacggccgcatctggactactccaccgcccggtggatcctcaccctgttccacctgcggaccatcaccacgccgcagatgctcgggcagccggcgctcgagggtgtgcacagcgacggcgtcgaccacaccatgaccacgctgatcgacagccgcaacatgaccccggacagcgcgatcacctacctgcacgaccggcgcgagcgcaacggcacgccgtggtacgcggtcgaccccgcccacgtcgtcggtcatcaccagcaccgcggcttcctggacaccatgctggtggccgaccacgagcgcaagcacagcgtcaccccggtgcgggccgaggatccgacggacaacgccacccgggacatgctgatcttcttcacccgccggcccgccaccgagaaccacatctccttcccgtacgactcgcaacgcccgcacgccgcgacgccgatggagatcgacattccggcgtacgccatgaccggcgcggttcgacgatgaccaccgccgtcaccccaccgcgtgccggcctggaccggtcggtgctgatcgcgctggccggtgtggtgcagcgccgggtgctgctcaccatgaccgcgatggccgccctctacgccggcgcgctgaccctcgcactgcgcctggacgagccggtcgtcacggtcgccgcgacgctggcgctgaccatggtcatgtccggtttcatccaggccgcccacgactgcgtgcacggctcgcacctgcggtcccggcgcgccaaccgggtcatgggcgccgcctggtgcaccccgatcctgatcaacttcaccaactaccgctaccagcacctggtccaccaccggttcaccggtgtcccgggcgacaccgagccggagaagaccttcaccggcctcggcgcatacctctactcgatgagcggcatcacgctctggcgctacaacgtcatcaccgccacccgcacctggcagcaccgattcccggccagtgtcaccggccacccggaccggcgccgcgcgtcgcggcaggacaacctggtcatctgtctctgggtcgcggtcgcgctgacgctcaccgcgattttcccgtacgccgttctgctcggctactggctgcccctgctggcgtccaccgtggtcgcgcggttcaccgggctcaccgagcactacgggctgtggggtgtgccggacatcgagcgcaacacccgcaccgtgcggtcgaacccggtgatgcgcttcttcatgtggaacgccaactaccacgccgagcaccaccggttcccggccgtgccgacgctgaacctgcaccggctgcaccgggcgctgcccgaaccgcatccgctgcaggccgcctcgtacaccgcattccatctgcggctgatccggcatctcaccccaggagagacgtcatgagcgacgcccaggagcggacctggcacgacgggcgatgccactgcggcaacgtgcgtttctcggtctcgctcaccagccacctgaccgtgaccctgtgcaactgcgggatctgccacatgtccggccatcaggagctgatgctgcccgaggacttcttccggctgcaccagggacaggagttcctcaagccgtaccggttcggcacgatggtcgccgaccacacgttctgcgcggtctgcggcatcatgccgttctaccgtccccggtcccacccgaccggctacttcagcgtcaacgcgcgctgcctcgacctcagcttcgccgagcacgtcgagtacgccgagttcgacgggcagaactgggaggccagcatcgccgccggccggcacaaactgacagcctaggcgggacgaccggcatgcgcagagtcatcatcgtcaacatccgggccgactacgcggccgacatcgtgcaccggctgccctcggtcacctcctgcctgcggctgatctggatggcccggcccggcgacgtggtggtggttccggccgcggtcgcccccgggttcctcgcccacatcgaggcgacgctgggctggccgaccgggtcggtgcgggtgctgtcctggccgggcatcctcagcgacgaggtgctgacctccgacgagttcaccgcggcgctgcgccccctgctggacgcgaccggctggacggtggcgccgtgcttcgtcaccgagggcaccgccgccctggccgaccggctcgggctgccgccggcgccgggtgacacgttcgccgcccagcgcgggttcgagctgttcaaccgcaagtcgcacttccgccagatcgcggccggcgccggcctgccgctggccgccgggtcgatcgcgcgctcccccggcgcgctgtcccgggcgatcggacgcctgctgccggagaccgggcgggtgatcgtcaagactgacaacgccggtggcggcagcggcaacatcgtgctgaccagcgacgacagcggcccgctgcccggcgcccgggagacccggcggatacgtggtgacctcaccggggtcggccggcgcatctgggacgaactgaccgacgacggcagccgggtcgtcgtcgccgaggcgtaccacccggcggtacggatgttctacttcgagtacctgatcgacgaggccggccgggcgcggttcctgaactcgggaagcatccgcctggagccggccggcgacccggacgcgcccgcactgtcctggatcggcctgcggatcccggccgacctgccgccgttcagcctgaccgaggcggccacctgggccgcggcgtacgccggtcacgccgcccggctcggctaccgcggccacctcaacatcgacgccatgctcaccccggaccagcggctgatcttcaacgagtgcaacgggcgctggggtggcgggctggtcctgcacgaggtggcagaacgcctgctcgggccgcgatacgccgaccgctggctgctgaccaacctgcgcgacgtcccggccgtcccgcccgggtcgctgcccggcctcaccggggacggcgtcatcgtgctggccgccgacccggacggcggggagccgaccgagtgcctgctgttcgccgagaccccggagcggctggcggcgatcgaggacacggtccgggacgcggcttcgcggctgaccggaacaccggtctgaccgtggatcgcggcggcggacccacggtcgcggcactgcgtgccgccggccatctcaagtggaccggcgacggtcccggcctgctcggcgcctcggtcgcggagatggatttcggcaccgcccccgcggtggcgacggcactgacccgggcgatcgacgacgggctgctcggctacctgcccccggccctggcccgggccgcggcccgggcctgcgccgactggcagcgcacggcatacgggtgggcggtcgcggacgacgacgtgcgcctggtcccggacgtggtccgggccctgcacctggcgatcgcgcacttctcccggcccggctcgccggtgatcgtgccggtgccggcgtacatgccgttcctgacggtgcccgcgatgctggaccgggagatcatcgcggtgccgatggcgcagcaccacgacggcgcgccccgcttcgacctggaccgcctggaccgggccttcggggcgggcggcgacctgctgctgctctcctcgccgcagaacccgctcgggcacgtcccggacagcggcgagctactggcgttgtcccgggtcgtcgacgcccacggcggccgggtgttcgccgacgagatccacgcgccgctggtctacaccgggcggcggcacatcccgtacgcgtcgatctcaccggtcaccgcggggcacacgctgaccgccacctcggcctcgaaggcgtggaacgtggccgggctcaaatgcgcgcaggtgatcctgagtaacgacgccgaccggaaacgctgggaccggctcgaccggctggccaccgacggcacctccacgctgggcgcggtcgcgaccgccgccgccttccacgacggccggggctggctcgactcggtgctcacccggctggaccacaaccggtggcggctggccgacctggtccgcgaccggctgcccggcgtccggtacgttccgccggccggcacctacctcgcctggctggatctgcgcggcctgcgccggcggccggacgacctggccggcgtcgtcgcccgtcacgcgcgggtcagtgtcgtcgacggggccgactgcggcgcccccggcttcctccgcctgaacttcgccaccaccgaaccgatcctcgtccggatcgtcgaccagctggccgggccgttaggagagtggacatgaccaccgtcgtcgtgcttgaaccccagtcgtccgggctgtccctgctgcgctacggcaaggcggccggccaccggatcgtggtgctgtcccgcgacgccggcgaccggcgcgtgccggacgaccaccgccgctacatcgacgaactcatcgaggtcgagaccaacgaccaggccgcggtcgatgccgccctggaccggctgccccggatcgacgccgtcgtaccgggcctggagttccacgtcggcgtcgccgcccgggccgccgcccgcctcgggctgcccggcctgccggtcacgacggtcgacctggtccgcgacaagcacctgatgcgggccgctctcgaccgggccggactgccggcgccccgctgggcggcggtgacgtcaccccgggaagccgtccgggcggccaccgccatcggctacccgctggtgctcaaaccggccgacttctgcggcagcttccacgtcaccaaagtcaccgacgaggtggagctgaccgccgcgtaccggcggatggccgccgacgagacccgcgacttcggccgcaccgccggcgcccgcgcgctggtcgaggagtatctgaccgggccggagctgagcgtcgagggatacgtgcacgacggcagggtcacggtggcggcgatcgtcgagaagagactgtcgccggagccgtcgttcgtcgagatcggacacgtcgtgccggccgagctcgacgccggcgtcgcggaccggatccggcggcacaccggggcggtcgccagggcgctcggcgtcaccatggggccgttccaccacgagatccggctcaccgcggacggcccggtcaccatcgaactggcggcccggctggccggcggccagatctacgagctgatcgaactcaccaccggcgtctgcctgccgcgcgcgatgctcgccggctatctggggcgggcgccccgggagacccgcacgaaggacgcggccggcgcggcggcaacggtgttcttcatcccggccgggccggtgtccggcacccgtgcgctcggcgcggatcgggtggaatcgctgccggggtacgtgcggcaccggttcaccgtcgtcccgggtgccgcggtcccggcgggcaccgaccatcggtgccggctcggctacgcgatcctgcgggcgggcagcaccgcggaggcccgccggctcagcacgaccgccgccggactggtcaccttcgagtgaggcgtctcgccgccgcggcgcactccgccaccgcgcaccgtgtcgagggcgcggggcgtttcggcgaagccgggtgtttcggcgacgcggggcggggaacgcgtccgcgtcatcgcaccatcgcccagggcggatcggacgtcactcatggccgcggcaaccttcaccaccctcctgacacccgccaacgcctgcgcggcgctgcccgtcgtggtcgaggaggagctgctgctggccgaccgggacaccggaacggccgtcccggccgatgaggcgctcgccgcggccctggcgccgcacggacgggtcatcggtgggacggtgacgctggtgtcgtcgccgtcgaccgctctcaccaccctccgcgcggatctgctgcgcggccgacgagcggccgccgcggccgccgcggaacacggcgcgcacctgctggcggtcggcatgacgcccgaagacccggcggcggccctctgcggcctgacgattcacgtcggtgttcccgacggccgggcggcggtgcgggtatgccgccggttgccggcctggttgccggtcgtcgaggcgctcaccgccaactcgccgttcgcccgcggcgccgacaccggccacgcgagctggcgtttcgtgcaggcccaacggcgcgcgctcggcgcgttcgggccggccctgcggtcagccggcgcgatcgccatgaccccctcgggcgccggggcctcgcggtccgacgaagctttgccatccggcgaggcttcgctatccggcgaacctttgcgatccggcggacctttgcgatccggcgaagcttcgctatccgccgcagcttcgctatccgccggagctttgcgatccgccggagctttgcgatccggcgaagcggccatcgaagcggccgccgcggtgtccgcggccgtccaggcggcggaggccggcctgccggagtcgctgcgctactggcgggtgcggccgagccccacgccggcggtccagatccgggtcggcgacgtgggcctgagcgccgacgacacggtcgtggcggtcggtctgctgcgagccgccgtgctcgccgcggtccaggacaccgggcccgggcaccgaccggtcccggtgggtccggcggtgctccgcgctgcccactggcgtgcgtcccggcagggtctgcaggcccggctgttcgacccggcgagcggccgccccgcgccgtcctggcacgtcatcgatcagatcgcggcggccatgttcctcccgtcgggcgatttcgagacggtacgcgacgggttggcgcgtctgcgcgacgagggcaacggcgccgaccggcagcgccggatcgtggctcgggccgacgacggccgggccgtccgctcggcgctcgcccgactgaccatccagggatgagccgatctgccgtcatcgacgaatggcttcgcggatcccgggcatcccggactcgacggcgcacgttcgttgatgaacgctgggggttctctcatgcctacgacaactggggtgacgatcgaggacgacctcgatctgatcgccgaggagtacgcgcgtctgctggccacggccgaccaggccaccgatcggcgcctgcgcgcggagatgatcgatcggatggtgccgttcgcccggcgcctggcccagcgttaccggcacagcggcgagccgttcgaggacctcgtgcaggtcgcctccctcggcctggtcaaggccgtgtcccgctacctgccggagcgggggtcgttcaccgcgtacgccgtcgccacgatcagtggagagttgaagcggcacttccgggaccacacctggtcggtccgcgcgccgcgccgcctgcagcacctggccgcgcagaccagggtggccgaggtcgagctggcgcacgagctgggccgggcgccgaccgagggggaggtggcgcagcgctgccacatcgactcggagacgctggacgaggcccggacggcggcgagcggataccgtgccgtgtcgctgagtctgccgctcggcgagggcgacggcgagctcgccgatctgctgggcagcgccgaccccgcgttcaaccaggtcgccgactatctcgcggtggccaaactcgcccgccggctcccgccgcgggtccgccggatcctgatcctgcgcttctaccaggaccgtacccaggcccagatcgccgccgagatcggcatctcgcagatgcacgtgtcccgggtgctcacccgggccctgacctggttgcgcgaggcgctgctgcaggacacggtgccgccctggccgggcaacgacgccgacccgatggacggccgggtggtcagccgcctgcggccggacggcgcgaccgaggcccggatctgcggcgagatcgacgcggacagcgccgtcctgctgcaggagacactcatggacacgctgcgccggctgggcggcggcgcgctggtcctcgacctggccggggtgtcgctgctgagcgccgccggagcgcgcgtgctgcgcggggtggcggacgccggacgcgcccacggcgtgacggtccggctgaccggtgtgcggcccaccgtccgccgggtcgtcgcggtcgccggcctgacccgcctgctggcgcccgcctgatcttctttcggtacgcggatgaggtttgatggacctcagacagcgcagaacggggaggcttcggtgcccgacgctccggacgagctcgacgtgcaggtgggccgggcgcgggcggtccgtgccgtcttcgactcgatgcccgtggcgctcgccgggctgaccggcccgcagcaccgggtcgatgcggtcaaccacgccttccgcgaggtgttcggcggcttcgccgtggtcggcctgccgctgtccgtgcccgccctgttggacatctgtgaccaggttttcgtctccggtgtgccgcagacgttggacggctggccggccggggaccgggagatcgacctgacggtcgcgccgcgccgcgacgccgccggctcggtcgccggtgtcgagctgatcggtgtcccccggcgggagtccgcggcggccggcgacgaggtcgccgcggtgcagcgcgagctgctgcccaccggtctgccgctgctgccgtccgtgcgcctcgatggcggctacctgccggccggggacgccgacgcggccggtggtgactggctcgacgcggtcgcgctgggcgagggccgggtcgcgctgatcgtcggggacgtggtcgggcacggcgtggccgcggccgccgcgatgggtcagctgcgggcggtgctgcacgaccggctcggcgcgaccggcgacctgctcgacgcggtcggtgccgccgaccgactggcccgccgcgtgcccgaggcctacgccgccaccgtgtgcatcgtccagctcgatccggccgacggccggctcacctactgctccgccggccacccgccgcccctgctcgccggtccgcgcgcggcccgcttcctgcccgcgtccgggcacgggccgctcggcaccggcgccacctacctggcccggaccgcacggctggagccggacgagatcgtgctgctctacagcgacggtctgatcgagcggcccggcggcaccccggccgccgggaacgacgcgctgtgccgggcggtggcgggcgcgctgtccggccccggcccgcgggacgtcctcaccgcgctggacctgctgatccagcggaccggccacaccgacgacatcaccgtgctcgtggcggcccggcgcgacccgccgccatcgctgcggctgaccgcgccccccgggtcggtctccgtacgcggcctgcgggccggcgtcgaggactgggccgatgccctcgccaccggcgaccaggatcgggtcgcgttcgctcacgtggtcaccgagctggtcaccaacgcgctggagcacggcgccggcacggtcaccctgaccgccggggtgagcccggacggcgaggcccggatcaccgtcgcggaccagggtcgctggcgggagcggccgcggcccggcgacgacgacttccgccgcgaccacggcttcgggctggccatggtcgcgtcgttcgccgaccggctggacatcgacaccggcgcggtcggcacgacggtcacggtccaccgccgcctgtcgcggccgctccggccgctgaccgccggacagtccggcagtgtgcggcccggcgcggatccggagctgatgatgatcgtcgaccagccaaacgcgccgagcagtcgggtggcgatccacggcccgctggacgccggcaacgtcgacgacctgagcgccgagctcgatcggctcaccctgggcggcagtcacgacctcgtcgtcgacctcagcgcggtcaccctgctggccagcgccgcggtcagccagctgtaccgcagcgacccgcgggccaccggccggcgctgcccgctgcggctgtacgcccccgccggcagcaccgccgatcaggttctcaccctggtcgacctgccacatgccaccgtcgatccgcacgctctggcacgctgagcggcccggcgagcggccgggccgcctggcaggtggtcggttggcgtggtttatcactatatgccaggggtaggcaggccgcccgcgccggaacggcccggcgcaccgcaagccgaaggacgatgccccatgagctcgatgaccgcgaccgccaccaccacgaccggaccggacacaccgccggcactcaccctcggggtcgaggaggagttcctgctgctcgacccggccaccggcggcaacgtaccgctcgccgaccgggtcaccgccgccctgccggagccggtccgcagccgcagccggcgggagatgcgacgcagcatggtggaggtggtcaccggggtctgcaccggactgcccgacatgcgggcgcaactggcggagcagcgccgggcggcggccgacgcggccgacgcggccggcgcccacttggtcgccatcggggccacgccggtgaccgagcaggacgtcaccgtgccgccggacccgcgatatcaggatctcgtgacccggtacggcccggtggccctcgaccccgcggcctgcggcctgcacgtgcacgtcggcgtgccggaccgggagatcgccgtgcaggtgtgcaaccacctgcaggtgtggttgccggtgatccgctcgctcaccggcaactcaccgttcttccagggtgtcgacaccggacatgccagctggcggtcggtgcagctgctgcgctggcccagcatgggtccgaccccctacttcgcgtccgcccgcgagtacgaccgcacggtggcccagctggtcgcctccgggatggtgctcgacgaggccgccatctactggtacgcccgtctctccccgacctatccgaccgtcgagatccgggtgggtgacgtctgcaccgacatcgacgacaccatcctggtggccgcgctcgtgcgggccgccgtcgccaccgcgatcgccgacatccgcgccggccggcccgcaccccgcccgcgggactgcctgctgaacgcggcgaactggcagtccgcgcacgacgggctcagcggggacctcatcgacctgcgcctgggccgcgcccggccggcctgggaattcatcgacgagttcgtcgccacggtcagccccgcgctgcgggcggccggtgacctggagacggtgctcgacgggctcacccggctgcgggccggcggcgacggcgccacccggcaacgcgcgatccaccacggaaccggcgacctgcgcgcggtgctggccaccctggccgcctggacccgtgccggctgagcggccggtcgatcagctcggcgggcagcaccgtacagggggaattcctcgagatccttttccgccgccggcggcctgccatgcgggtgggcacgacgcggcgagggtcaccagaccctgatcccggaaggggacacaaacctccggactcgccagtggcgctcgcgcgtcccttcgcgcccacccgggcgggccggcgaaacggcgcccgaggtgcccggtatgaacggtcccggcgggggtaagcgaccggcctcccaccgaaaggacctgccatgaccggctacggcgacgacgtcggtacgacatcggaccggtacaccatcaacgccggccgctactgggccagcgccgtcgcggccgccctggtcgcggccctggtcgcgatcgccggcgtactcatcgcccgcggcctgttcgacgtgcccgtgctggcccgtcgcagccacggcgcctggggcgacgcacacaccgccacctacgccaccggcgccgcgctggccaccctcctcgccgccggcctgctgcacctgctcaccctggccgtcgccgagccgcgccgcttcttccgctggatcatggccctgatcaccctgatcggcgtcatcaccccgctgaccctcgccgacaaacccggcccgagaatcgccaccgcgctgatcaccctggccatcggcgtcaccatcaccgccatcctggacagcgtcgcctccgccaccagccacccccgccctgccgagcagcgcgacgccctggccgccacccgccggtggacggccgagcccccaacgtaccggcaaagttgatcattaacggggaccagccgctcagcctgccgggcatggtgtggcgacggcgtccaggttgcgattcttgtgcagggagctgaggcgcaggcgatgagactcggcgcagtattcagccggcgccagatcgtactcggcgtgcagcaccgccttcccggcccggatgaaaggcgtcaggcgcgagcactcggcgaaggcggcgcactcctcgttgaccgtgaagtcgaagtcgccgaccagctcggccgcctgctcgacgtcgttcttgagcgccacggacaggccgcgatcgtgggcgagccgcgcgacgaaccgattgaaccgcagctggtcggccgccgaggccgggaaacccgtgtcgttggcgtacccgtccatcaggtccggttcgatcgcgtcgaaacctttcgcccggcacatgtcgaattgggcggccagcaccggcctcaatctcgccgggtcgcggatgtccagccaccgctcccccggccagccgttgggcctgccgagcagttccctgggccagtccaggtaatcggggcgaaactcctcggccgagccgacctcgacgtagcagaccaccctgcgcccccgacgatgcaggtcggacaccagatccgcaccgttgaggaaaccgtcgatgtcgtagaccgtggcgttcacggtcgggtcgaccggcacggtgagctgccactgccacgtgacgccgggtgcgggcacccaacgttgcgcgtccggctgtgacgtgacctcggtcgcgccggggcgcacggtggccgcgggcacgcccggccggcaggcggtcagcagcaacagcgtggtcagcagcagcgtggtccggacggcggcaaggcgccggccggtcatcggcaccaggcttcggcctccgccgccaggtaggcgggcaagccgtcccacgggttcgctcccgcccggtcggtcacgtagacgccgcccgccccggccgccgcggcccggtccagggccaggggcagcaactcctccggggtgtcgtacaccagatgccagagccggtcgggcggcagctgccgggcccagtccggcgccacgagattttcatacgcggcgtacggcccttcgaaggtcaccagcacatcggcgagtacggcgtagccggggtgcgggtgggcgccgtggttgaacaccaccgtgccccgcgtccggcgccggatgccctccaccaactcggtgtaccacggcaacagttccggctggctgcagacacggtcgaggaacagaccggcggtcggataccaacggtgccaccggtccacgtcggcgtgcaccgcggtcgggctgcgccggccgtagtcggtgtcgacgtagccgagcagcggacgaccggtcgccaccgcggcggcggtcaactcccgttcgggcgccggccccgggccgtcggccgagttcagcaccactgcgcgcaccgagctgccgtgtgcggcgagcgcccgccagtcgtcgccggcgacggcggggtgaaaataggcgggtacgaccagcgcgctcaccgggcggggggaggatcggcgacacccatgtcccgcagggacgtcagcagcgggtacgccggctggaaccccagcgtcgacgcggctgcggtgatgtccgcctgctgccaggtgaccgcggcggaccgcggcgatccgctgcgctcctcggccggcatcgccaccccggccatctccgccgccatggccgccagatcgcgcaggggggtggcgcggccactgccgatgttgagaatttcgggcagtggaccggccgcggtgaccgccgccgctaccgcctcggccacgtcccggacgtcgacaaagtcgcggtgcccgtccaacgggcccagttgggctcggtcgccggtgaccgcggaggttcgtaccgctgacaccaggcgaccgggaaggagcgtctccggggtgcccggtccgatcgggttgaagatccgcagcacggtggcggccaggccgtcgcggcgggcggcgagcaccagctcggtcccggccagcttgctcattccgtacgcggacaccggccgcggcgggcagctctccggcaccgccaggccctccggcaccggcccgtattccgccgccgagccgagatggatcagcttgccgtggtgggcggacgaccgcagcgcggcgaggagccgggccaccgcgaccacgttgccggcggccaggccggccggatcgccgtccgtcgtcccggcgcagttgatcaccacgtcgggttcggtctcgcgcagccgggcgaccagttcgtcgtggctcgcaccggccaggtccagccgcaacgggccggaccggccggccgggatcacggtcaccgccgggtcggccccgaggcgctcacgtacccggccaccgatgaacccggaagcaccgatcagcagacaacgcatcaggccgcctcggcccgcagctgcggcaacaacagcggagcgagcaccccgaactcggtgttggcccggtcgtagtcgtccggccggccgatgtccagccagttgccgtcgaattcgtactcggccggaccccgtccctgggccagcatgtccagcaccagctcgtcgaaacccaggggcaggcccggggtgtaccggcgcagtgcgctcgccgacatgccgtacacccccatgctcacccgatagtccatggtgggtttctcggtgaagtcgacgatgcgaccgcccacggaggtcagcaccccgaaatcgatcttcacctgccgggcgaaggtggcgaccgtcagctcggacccgctgttgcggtgccggtccagcagatcggcgtagttcaggtcggtcaggacatcaccgttcatcaccacgaagtgctccggtagctggtcgcgcagacccagcaacggcccgatggtgcccagcggcgactcctcggtggtgaagtccacccgctccaggccccactgccggccatcgccgacgtaggcccggatcaggtgtccgaggtggccgatcgccagggtcgcggagcggaagccgaactgcgacagctgccgcatgatgatttccaggatcgagtattggtcaccgatcggcaccagcggcttcggcagcaccgtcgtgtacggccgcagccgcacgcctttcccgccggccaggatcactgcgtgcatggtcggttctcctcaacgcgcgtaggtgccggggcggtacttggcgaggttcgccgggtccaggaaccagtcgatggtcagcttgagcccggaggcgaggtcatgggccggggcccagccggtggccgcccgcagcttgctgctgtcgcagaccagccgcatcacctcggagttggtcgggcgcaaccgttcgttctccagccgcaccggcaccggccggcccatcagcgcgcagatcatctcggccagcttgccgatggagatctcgtcgccggtgccggcgttgaaggactggccgaccaccttctcggccggtgcggtgccgacggtggcgaacgcctcggcggtgtcgtgcacgaagaggaagtcacgggtcgggtcgagcgcgcccagccggatctcgtcggcgccggcggcgagctggctgatcaccgtcgggatgaccgcccgggcggactgccgcggcccgaacgtgttgaacggtcgcatgatcaccgtgggggtgtcgaagctggcgtggtagctgtccaccagcttgtcggcgccggccttgctggccgcgtacggcgactgcgcctgcaccgggtgcgtctcactgatcggcacggtcatcgcggtgccgtacgtctcgctggtggaggtgtgcaccagccggtcgcagccctgctcccggaccgcctccagcacattgagcgtgccgatcacgttggtgttcacataggaacggggcgcccggtaggagtacgggatcgcgatcagggcggcgaggtggtaaaccgtgccggcgccggtgatcaggtcgcgcaccgtgtcgctgtccgtgacgtcgccggtgagcacttccacgttggccatcacgtcgggactgagcgcatccagccagccccaggtgccgagcgaattgtactgagccatggcgcgcacgcggtgaccgcgctcgaccaggttctcgaccaggtgggagccgatgaagccgtcggcaccggttactgcgaccgtcgtcatgagcagtctccttcggggatcaatacacaggcggagcgatacaccgggatcgatgcaccgcggggatcgaccgtggtatcagaggtggagctgggcccgtcgtaaggtcacgtgggcgtaggcgtacaggccgatcagcaagccggcagcggtgacggcttgaatggtctcgggtggcgcgaagggggccaggagcagactggcggccagcgcggccaggcaggccagcacggccggcccacggaggtggaaggacatcagcagcagtgccaggaacaacgccaccccggtcaacaccgccgcggcgacgggccaggcagccggcagcacgccggtgagcagcgccgtcagaccgattccggccaggaagatggtgaccaggacggccaggtatgcggttgtcaccccggacagggccgtggacgcccggcggccgaacgcctgcagggtgcgggcctcggccatcgcgcggcgggcggccgagcgatagcggaagagcagccactcggcgactcccatgctgaccgacagcggcagcaccatggccagggccgtcccgacaccgatccgcgggtcaggggtcgcatccagcgcccgggccaccggggtgaagatcagcaatgccccgaccacggcaccgaatgccgcattcggtgacgcggcggccacatccacccggctgggcagctgcgggcggacaccccgtaggtgctgccagcccgccaccacgatggcggcggccacactgagcgcggcggccgccgcgagcagaccggaaggacccgcgtccggcccggcgacgagtctgccgatcccggcgccgacgcccggaaccagcgcggccagcagccaccactcccggccgagcaccagagcgaccgtggcggccaggacatatgccacctgaccggcggcgatcagcgtgacggtcagcgaaacgccgagggcgatccccagcgctgccacgaccgtcaccgcgggcaacccgacgatcagggcggcgccaccgagtacggcggcggctcgctgatcggcccggccgagccgggcgtaccccaggtgagccaggccctgcccgacggtccaggacagcagcaccgaaacgaccagcagggcggtgggacgcggcccggcgatccggtccgcgacagccaggtacgccagtgcgggaagcgcgaacagcacgccccgcaggacatgcgtcaccggtgtggcctgccacggatcgggggccggtcgatcggcctgacgcactcgggggcgcagccggaacaaccggtcggcgaggtcgaagacgtcccgggccgaatagcgctcctgagccgccacatcggtgatcccgtcggcctccaacaccgcggccacctcgtacgagtcgaccgccacggcacagaccggcgacatcttctcgatcagatcggcgtacgggctgtcgacggtcatcggatacccgccgcctcgggaccggccgggtcgggtacgacgatgttcagtacgacggtgtcggcgacggcggtgttctccagccttcgcgactgccgaaaagccaggtcgtggtagatggcgtcgtagctgtcgaccgccttgtccacggtgaagttggccagcgcccgctcccgggcctgccggcccagttcccgccgccgggtgtcgtcgcgcagcagcgccaggcaggcggcagccatcgcctcagggtcacgcggcggcaccaccaggccggtgctgcccaccgcctcgctgacaccgccgacgtcggtggagaccgtcgcccggcccgaggtcatcgcctcgatcagggtgtacgggaaaccctcggagatgctcgacagcgccaccacatgcccggccgcgtaggcgtcgcggatctccgccacccggccctcgaaggtcgccgctccggccagtcccagtttgacgaccagagcctcgcaccgctgccgatacccctcggccccggccggggtgccgccgaagatgcgcagccgggcctcgggcatttccgcgtgcaccagtgcgaagctgcggatcagggtttccagatccttgatcggatcgacccggccggcccacgtgacggtgggtgcctccggctccgcgccggccgtcgggaagtcgtcgggttccacgccgttgtagacggtctcgatgagctccgggtgcgcgccgaacttcgtctcccagcggcggttgtacttgttgccgggggcgaccagatccgcgctgcggtacaccgtggtgcagagcagccggaggaacgcggcgagagtcgccttgatcggccagttgtactcggcggcgcgcagcccgaggtatcgctcacggaggtagacgccgtgctcggtgagcagcatcggcgtgccgtaccgccacttggcggcgaggccgggcagggcggccagcccgttggtcaccgcatgggtgacgtccgcccgcggcgtcgggtgcagcaggggccgcagtgaacgctcgatgacgtccaccgcggtcaacgcgtccagtaccgacggcacggcgacctggctcagcgcggcgttcgccgcccacgccttcaacagccggctgaccgccatttcgccgtacggggacaggtccgtccccaccgtctcggatgcggcgtgttcgacgatcccgcgcagcgccgccgcgaaggcgtcggcggccgactcggacggcagcagcagcgcttcgatcaggtccccgtacgccgaggcgagccgctcggcggtccggggcgtgcgggaccggggccggccggcgaccggcggccacagcgcgatgccgtgggccgtgacgttcgccggcagttcccacacggccggctcgacgccggaggccacgatcgcgtacacgtcgaactcgtggtgtttcaagccacgcaacagctggtcacaccacacgctgaccccacccatcgagtgcgggtaggtcccctccgtgagtagtgcgaccttcacggaagcaccaggtcgacggtgccgttgacggcgggaatcgtccaggccgagcggttcccggcgtacgcctcaccgaaggtggtcgtgccgcgccgggtgccggtgatggcggtgatcggcgccgcgagcgaggccggcgcgtcgatgtgcacggtcttgtcctggaggtaaccgctgaccttgccgccggcgacggcggcgcgccaggcgttctgccgctgcagttccagaccggccgcgctcatccgcgggttgacgaacggcgcgttgtcggcgatcagcgaccggtaccgggtcaggatgctgtccatcatggtcagcaggatccggtcctcggcgaggttggcctggtgcacgtagtacgggcgcgggtcgttgccgagggtccggttcagcgccagccgggtctccagcggcacgatgtagtcctggtagccggtggtggtgttcagcggcgtgatgcaggtggtggtggccgggttgtcctcgcagatgccactgccgccgtcggcccgggacgtgtagatccagttgtactcgtcgaccatctcggcgcgcttgccgacgttgtagtacgcggtcatcgggtaccgcggcacggtcagcgccgagccgacctggatctgctcgggcatccgggagttgtccgcggccagccacttgatgccctggctggtcagcgccggcgccaggttcgggttggtctgcggctgttgcggcaggtagaagagaccggagtgctcaccggtgaccagctcggtccggtcgatcggcagctgacgcaggaagctcgtcgcccaggtgacgttcttgctgatctcggagttgatgagggaccgggaggcccagtcggtggtgcccgccgtggtggtcgaacatttccacgggatgaccgtgacgtcccggacacagcccaggtactcgtggttccaggtgtggttggtccaccggaagcttccccggcgtgccacgagcgcagcggtcagcgggtccacgccgaggaacgcgtccgcggcggcctcggcgctgccgttgccgttgaaaaccatgtcgaaggtgaagttgcggctggtctgccacgacgagacggccgacacgtcggcgctggtcatccggatgtccgtggtggcggtgccgtccgggcagtcctcacccggggtgcagttgccggtggtgctccaccgggcatccggcatgaacacatcgtccacctgcaccgacaggaagttccggctgaggcccaggtgcaccccgccggtcatccagttgacgatgcccggggcgagcagccggaactgctgctgagccgcgttgtagacgaagctcagcgagagttggcgccggttgtccgcccggtattcggtgatcaggctgttgccggcggtgccgttcggtgcggtggcggtcagcagcggcgtggcgatcgcgccggtggcgacgtcggcgggcgacggttccgcgagaaacccgtacgactcggtgaccgccggcgagttgtcctcgaacggcaccgaacccttcagatagctgaagacgcccaggccggccggggtcagggtcgcggtcacgccgtccagcgacccggcgtatgtgggcgtctgcaaacccatcccgacgccggggtagacataggcgttcacctgcgggatgtcgaacttctgctcgtacgcggtgagcgcggccgactcggcggcgttgccgaacgagtcgggcccgggcaccaccactgcctggtagtgcgcccggtcgaccaaccgcccgccgctggtgaccgtgtcggccaggaacgcggcgtcgaccgtgggccgcccgccgtcgcgcaggttgacctcctggtagggcgtcccctccgacttgagttcggccgcgatcgccgcggttgccggcccgccgtcggtgaccaccaggaccttcaactcgacccggctaccggccggtgccgccgcgaaggccggcgtgacggtcaggaccgccgtcgcggcggtcgcgcccgccgtggtcaatgcggaacgccaggagcgcaccatgttcccctcccgtagtggtctttcgtgcggggtcgtgccatcaatctgtcgaccggaggcttctcgctactgctggggaccagaaatagcaacgctgtccagccgtcggcagcaccgcggaggtatctgatctgcagcttcgacacgcgtaaggaacaattcacctggatgacacaagacgacgacgtacgaatcgcacatgcgaggaatcgggccaaactcgggtgccctacttggcctcttcctgcggagaccatagttcgcgacggcggggaagtgaacgccgtaggatccgtcggccgccaccgtcagttacgttgcggtcagcagtaatcactcatagctagaccgcggaagatctggaccaggggcgcagcggtgatgcatcagccgttggtgcggaatcggtgaccccatggaccggcagcggacaacgatgcgcggatcggggccgactttcggcgttccgcactggagccaagaaacgaaaccggtcgcaacgaattgtcgacctcgtcaaccggctgcgtggattgccgggttccgacggtcgccgtatcgacaggccgcatcgaatcctttggcaaaccgtcaccttcgctgcaagtgcccgaccggccggcaaagttcgacccgagcggccggggccgaagcgatggcctgcttgccgcaaaggccccagacggtggccggatggcgcggccggctgagccgaacgtcccccgccacctccaccggacggcgcactgcccctcccccgcacccgatggcgcgtcatcacgcccgggcccacgccgcaacctcagcgcggacgcacacgcggcgaaggcatcactctcagtagccacggccgcgcgggtgcccccggctccgagtggcatggctacgacttcggatagacggggtacaccggtcagtccgtacaaggctggtggcctactgcaggtcgactgcgtcgccggccgtggaggcggacgctacgtccaggcgcttaccgccgtctggaccggctcccgattacgccaccgaacacaccgtgaccagtcagcatcacgtgatgggggtgaagcggactgttcggcgggggaagtctttggggaagatcttcatgcggatgcgacgagataggacggccgccagccactcaccgaggccaccgtcgaattcctcccacaggtggccgcgcgtctctcccaggccaattcgccactgctccgggtcatcgctccccgcggtgatccagtacgccacgtcaccgttgtcggagcggccgcaggagagcaggtcggcggaggggtggggcagggtgtggccacgctccgccaggtagtcgagcgcccaggtagtgcgctcatgctggtactcgaggtcgagaccccgcttcgacccggcgtcagggcagaagacgtggaagaagttgccgaacgagccgagcccgtacgtgtccaccagcgatttgtagtccgacggcaggccggtacccagacgcgcctcaaccgcgctccagtcatttgccaccggcgcgttgtccggcgggacgaccaggtgccgaaacaaatcaagatcaaacatcactcaccatgcccgaagaggccagcagggttggaagtgagttggacgccgctgccgaccgcctccgtcctgatcccggtcgggacgtccgatgaccgcttcgctccgctgcgcaggatccggcgccacaaacagtggccgcaactgtcggacccgatctctggacgcggtcatcgactgttggcagccgacctactacgggatcaaccgtcgttgctgatcggcgtccgcctgtttcagatagcggccccctgcaggccggtacagctagtccagtaatgcctcgcaagcagcccgcggaggctgccgagattgactgacaagcgcccgacgaaatcctgcagattgcggcgcacaagccaaggttcgagccatgctcaacgctcagagatgacactgcagcccgggaacagccttccatttcggcgataggacagtagaaactactatttaaagtcactattcacagtgcagtggcagcatagtcgccgaccgccacatcctcaagaaaggacgaccaatatccatctggatcggcggtagccgctccgtcaatttccgtcagaatccggcgcagagcctcttccgcatcctgcgccatatccaagtctcggtcttttggatagaaagggtacctggcgtcgacctgcacaagcgactcccggaatgcacttaaagaagtattcacgacagcgcggccttcctcctgcggccagagcaggagtacattacccgaacggaattctagatataactcgacgttttccctggaatatcctaaaagaattccgtccgcctgcgtgccctcactaccagcggatatcaaaacaggtcgtttcgcgggcgtgaatatgttgacacgcacgctcggcaggccggtccggcacagttcgctccaaacgccttcggggcatccgggcggcatttcgccggaataggttaggaactccactttcacctccgaattattgttactcaaagatactattgatcagatccttaagtgcccctcttgctgcagatcgcgaagctggattcgcaaacggaatgctataggtaacgtccgcgtcgggcctcagttgcggcaagattgcctcaatgctccccttccctcgctgaacaccttgacaccctggacacattccgtattcagagtaaatttcatcaatgtcttctaagtcgaaattagcgtcgcggatatccgcgagaagccactgctccgcgtgcgcatcttcgttggaatgtgctacgaatattctgccctgaaccttggcagcggcgtacaagttccctttgttcttgtctataacccgttgatcacgcgtggctcgactgagatcggtgcttccgctttcgacttgcctgccaggatcggtgattgggcaggcaccgttgttgttgtgtaccagcagcggggtgttgcttgcgagcacatagtacgtgtgaaggccggcgatggtgaggtcgtaggtgactgcggtcgtgtggtacgtgcgcttggcggcgaccgtggcgacacctgtcggggtctgaagctcgtcgccctgctgaagatctttggcctcgacgaacgccgcttgtgtgcggtcgtagaacgggtgatggaaggtcgtcgtcagtgtgccggtcagggccgcaacgcttgcggcgagggctactgcgctgcgggtcagcttggatgggcgtttggcggagaccttcaggtccacgaagtcgtggtcggtggtggtgacgatgacacgctcgaccatctgggtctccgcgtggagttttcctggctccgcgtctttgaccttgtcgcccacccggaccttgtcgatggccttggtggtgccatcggcgagcaggaccttggtcgtgccggtgaagctgtgcggccgcgccgcgcccccacaactgctctcctccgatgccttctccggttccgaggcctccgacggctcttcgcctggcctgtcagccgcgcgggaggcgcttgagtcctcggccgaggaggccgcactgtcggcggcgctttcggcgcctgccgaggcggcactctccccagccccctcggccgtggcctcggcgctcctgccgaacagaccgccgaccgcctcgagggctcggcccccgaccgccttcaggaacttgccgccgatcgcgccgcccaggccggacagcccaccgatgacgccgccgaccaagcccgcaccgaggaacgaggatgcgccgcactgcgagtggtccttggcgcatttgaagccctgatcgaccaggccgccgatggcaccggaaaccgcgccgcagacaccggctccggctacggcgccgacaccgccggtgacggcgcccaggactgcctcacagcccatgaacgccgccgtcgagacgacgaacgtggcgatcgaggccgcgtggttcttgacatacttcaagcccttctgggctagtttgtcgacttgggcgtcgagcgccttgagctgattcttgtacgcctccgccttcgccttgatttcggcattgatggcggcgaatctggcctgttgttgcttgagccagccgttgaaggctttctcctcggcccggaactcgtcctcgatcctgtggagggcctcctcgctcttgcggaccagcgcgttccaggtgttgctgacgaacgaggtggtggcgtgccaggcctcggacaccttcgaggtcgtccagttccatgcggtcgagacggcgtgtgtggtcgcgtgccaggcggtcgacacgacatgagtggtggcgtgccaggcgtcggagagccaaccgtggccggacgggtcggtgccggtcatggggtcgtcgtcgacgaacgcgaaggggttggccgcggccgacttgggcaccgggttctgcgccgcggtgtccttgctcaggaactgcccgttggccgggttgtaccagcgcgccgccatgttgacgtttccgctggccgggtcggtccagcccgactgatagccgaggttgccgatcgtcgcgtcggaggcgaggaccttgccgagggggtcgtacgccgtggatccagccagcactgccgacgacgcgccgaacgtaccgacgacgtcggtgtgccggtcgacgtatgccaaccgcttgtcggatccggaggcgatcccgagcagggagccgcccgggtcacggctgtacgtgctggtcccgtccgctgcgacgtcgttgccgacgccgctgtaggtgaaggaggaggaccccgacgtcaacgtccgcccgagggcatcgtaggtgtaacgctgagtgcccgaggcggtcatctgcccgtacgcgtcgaagttcgccacgacgtcgcccgactggctccgggttccccgggccgaatacgtgtacgaggtcttgccgtccgacgtcagctcgtcgcgggcgtcgtaggtgaacacgtcagagccgacccgcacccggttgcccgagtcgtcgtagtcgtactgcgtcgtggcgggcccgttgtaccaggtggtgagccggtcggcctggtcataggcgtaggtgttggcagccgatccggcgaagcccgtcgtggtcttcgacgtgacgttgttgttcgcgtcgtacccatatgcgatcgacgcgaccgcgtcaccggcggaggtggtgagcctgtcggtggttatccggtgcagcgcgtcgtacccgaacgaccggacgtccgcagccccgtacgtgatggagctgacctgcgacatcttgttgtaggagacgaccagccgggccccggtggaggcgtcgtcgaccgtggtcaggcgacccgtgccgtcgtacgcgtaactcgccgtgcccgccgcgtcggtacgagccgtcatctgcccgtcgccgttgtacgcgaagctgctgacaccgccgtcgcctgccgtcgacgtcaggtcaccacggtcgtcgtacccgaacgtctcggacgaggagacggcaccggcggtcgacgccgacgtcacccgttggtccttgtcgtagccgaacgtccgcgttgccgtgtcggcttccgcacccttgccggaggtggtcgtcaggttgccgaccgcgtcgtaggtgttggacaccatgactccgccgggcagcgtctggctgacggccagcccgcgctcgtcataggtggtcgtcgtggtccggtcggcatccgacgtgtaggtggcggtgggcggctcgacggtcgactccggcagaccccagccgttgtacgtgtatgtccagctgttgcctcggccgtcggtgaacctggtgcggtggccggcggggtcatagccgaacgaggtggtgatcgcgtggtcgtcggcgaccggctgcacctccctggtcaggtcgttcgccgtgtcgtaggtgaaggtcgtggtgtggccccgcgcgtcggtcgcgctcagcttgttgccgttgccgtcgtaggccgccgaccgggccgtcagcaccgttccgtcggcgtccagcgatcgcagcagcaccgggttcgagccctgatcgaacgccaccgtgctcgacgtaccgtccgggttggtctgcgaacgttcgcggcccagcaggtcgaagccgtatgtggtggtgttgccggcggtgtcggtcttggcgaccggctctcccaagttgtcatagcccgttgaggtcgtcgcgccggccggcgacgtgaccgatgcgagccaggcgccgcccgggttcgtcgccgacgccgcatacgagtaggtggtggtcaacgcgaccgggctggggtgccgctcgatgacggtactggtgaccatgcgaccgaggtggtcgtaggtcgcgtccttctcggcgccggtcggatcggtgacgctgagcgcgtggcccgctttgtcgtacgttgtatgcgtgacgccgccgtcaggagtggtcgtctgtgtctggtcgccgagctggtcgtagaggtagctcgtctcccgcaggtcgggatcgtaggagtcgaccaggttgcccacggagtcgtacttccgagtgactgtcgccgtgatcggcacgaacgaaccgggctggaagtagttgggtgtggtcttgctgaccgtgtgcccgtcccggtcgtacgaggtcttggtgacgttcccgttcgcatcctgggactcgaccggctcgccgaacgtgtcgtatccctgcttggtcgtgggccggacgctgcggggtgcacccccgccggtctcggtgtcgacggccggcgccgtgacggtcacgagtcgcccggcttcgtcgtacacgaagctcgtgatgtgctggtcagggtcggtctgcgacgtcggaaggccgcgctggtccagcgtccaggatgtggtcaggtcgtccgtgtagccggggctgttagtacggatcgacttggcggtgaggtgacccgacttgtcgtacgaggccgtggtcgtgaccgtgttgccggctccgtcgctcgcgacgttggtagccacggcgtcgtcgggcgtgtaggtcagtgtcgtcgtgcgcccgacgccgtcggggtcgacgatggtcgacgtctggcgcgacgccgcgtcaaccttgatcagcgtggtcgtcgccccgttgttcgtcacttccttgaccaggtggccagccgcgtcgtacgtggcggccctctccacgtacgggttcttgccctgatagtcggtccgcgtcgtcgtcacgggcagcccgtcgtcggtgtacctgtacgacgtggtcgtgccctgggcatcggtcaggctcgcgagccgcccggccgggtcgtacgcccgggacagctcgaccagccgcgtcgccggctgcggattcgccgggtccccggtgtaattggccagtacctgggtctgcaggcgcccgtcggggtcgaacgcgtactccgtacgggtgccctgcgcgtcgacctcggccgtccgctcgccgtactggtcgtattcgaaggtcgtggtgttgttctccgggtcggtcgtcgacgacacccggtcgtaggcgtcgaacacggtggtcgtcgtccgcgagatgtcgccacccgtcgcatcggccaacgtctgcgaggtgatgtcaccgtcagcgtcgtacaccgtgcttgtcaccgcggtgtgcaccttgccggtgatccggtccgcgatcggcggctgcgactcggtgacaagatggtcctggccgtcgtaggcgtacgtcgtggtcagcccggaggggtacgagtcggataccgccgtcttgccgatgacccgcccaaggttgtcgtaagcgagcctggtcaccagcccgtccggatccgtggtcgatgccacatcgccgttcttgaagtacgtgaccaggttgatcgcgccgcccggcgaggtcgtcttgtacggcaggcccgccggcgcgaacccaccgtcggccgccgcgactgtcgtgccgtcggtgtagtcgaccttcgtcgtccggccgttcggatacccgtccaccggtggcgtggtcacgcccgtgacgttgccgagcgcgtcgtggtcgtaggtcgtgaggtaggcgttgtcggtcggcgacgccgatcgcccgtcgcgtgtggtcagctggatgccggccgtgggatccgggttgtcgttgagcgcggtcagttcgccgaggtcgatgccgtacttgctcgcggtcgggctcagccgcagagcggtcgcgttgagcttcacgtaccgagcggcagtgggggcgaaggtgaaggtcgcctgcttgccggcggccggcacggccagattggtctgcgtcgacaccgtcttccaggcggtgccgtcggcggaaaccgcgagcgtgaaggtcagcgggaaaccgccggccgcgtcggtacgcgggtacagcgcgatctggtcgatcgtcttggtggagccgaagtcggcctgaacccactgggtcacgttcgccgaggtctgcagcgcggtctcgaagccgagcgcgcccgccaccgacgtcgtgttgccgtcgacgagggcggcgctggtgagaccggtcgtccccgagattccgctcgaggtgatggtcgcacccttcgccgcgtcgagacccatggtgttgggcgcgaacgtggcatagctggtcgagcacgcgtccgccgaccggttctggcaggtggtggtcgagacgacattgccgtcggcgtcgtggccggtcgtcgtcacgtgaccgtccggatcggtgaccgtgtgctggaagccgcccgagtcgtacccgaagctcgtctggtaaccgagtccgtctgtcgacgcgagcttccggtcgttgttcaatgtgtcgtactggtctaccagcgaatggccgccagggtcggtgacggtcaccgtggtcatcggggtgacaccggcggagttgcgcgccgccgcgtagtggccggcaacgtccgcagcgctcagcgccgtcgagtagaacgccgcttcggcgaaagagcccttgtaatacgccgtgctgttcacggtcaggccggtcgcgttcatcgccgtatagccgccgcccaggtaggcgtaagcgagctggctcggctgcagcgtctggctgctcttgctcgagttcaccaaccgtccgtcgacgtacaggctctgcgtggtggcgtcgctggtcagcacggcgtggtgccactgaccgtcggccgtggaagtcgggtacgccagcgactgcacccacttctgcgcgccgctgccgttgcaggtgtagatctgaagctgggtcttattggtggtgctgctcttgggatcgtcgacgcagaaaccggtgccgggattgcgcaggcctcccgcgtacgcctgccacagctgacgggctgcccccgtgcacgtggagatgtcgagcagcgatccgctcgtcgtggctccgcctacgatgtcgaggcacttgcccaggacccggaccgtaccgtcgggatacattgtccagctctgggcagcggaaccattgcacgtgtagatctgcaccgtgttgccgtcggtcgtcccgctgctggcgtcgtcgatgcacttccccatcgggctggagaaaaacggcccgatcggcgtcaccgacggcgactgcgcccgcaggatgccgtccgacgtcatccacatgatcggcgcggacgttccggtcgttcccccgattgctgcgccctgggtggagaggagtacgccgcccgtggtcatgccgtcggtcttgtaccagacctcctgcgagctggctgccgtcccgaggaggctcttgggcagcgagatgaccgacgacgtgccgttcatggtgaccgcactgctgtcctggaacggtccggacacccccagcgtcgtgttcgcgtaggcgccgggtgggtacgactcgtcgctgtaggcctgtgtcgcgcccgccgagtcgttcagccggtagtacgccgtcggtgccgagcccagcacggcaccgcggtaaacctgactcgacccggtcgtcaccggagcggacaggccccacgatccgccgttctcgtcggtcacatgcgtgaccgcggccgagaccgggtcgtaagtgaccgccgcgtacgccttgcccgaggctcgcgtcgccgaggtcatcaaagtctgcgggtgcaggccggcgttgtagatcgcggtttcgtcggcgagcgtgagcaccttgccctcgaagaacgccgcgtcgctgagcgatcccttgaagtaactgccgtactcggtggagctgttcgcgtcggtgtgcggctggtctggccagacgccgttgccgtcgacggagggccccaggtatccggtgccgaggtagttgtaaaccgactcggtcgccgcggtctcgccacgcccgagggtgccccaaccgccgatcgagccgacctgcttaccgtccaggaacatcgtctgcgcggtctgggaatcggtgaggaccacgttgtgccacttgctgtccgcgaccgacgcgctcgtggtgatcgggttcgcggccaacgtgctgctgctgatccagaactcgccgagcagcttgccatcggtgccgaggtacagcgtcggcatggtgttaccaccggaacgggtgttcgcgatcggcacgtcgttacgcgaccagagcacgcccgccggcgtgccggaggcggccttgaaccacagcgagatcgagtgcgagttcgacgaggccaggtgcaggttcggcaggttcactcgcgacgacgtgccgttgaacgcggccgaggtggcggcgctggtcgccagcggaccggcgccggccgtctgaccgagcgtcacgctggtgtaggtggcgttgtccgtgccctcgttcgccgcgacagcgctggccgccgttgttcccgaggcctccgcgagcggccagtacgacgtcgcaccgaggtcgagcacctcgttgcgctgcgctgacgccgatttggagtcgtatccgtatttgatgcacgcggtcgtcgtccccggcgcacacaccgaggtcagctggtcgccgctgtagccgtaggtccaggtgttcgcatcggcctgcccggcagtggccggatcggtggcgaccgacgtgacatgggccgccgaagcacccgacggcgtcgaccaggtcaagtgcagcgaccggcccgaagtgcccgaggtcaacgcggtgacgtgcccactcgcccaggtcagcgcttcagtacgaccggcgacatcggtgatggaggacaggccgtacaccccggctgtgatcgcctgcgtgaaggtgtacgtcgtgaccgacttgtcgatcagttcgtacccgttggcgagatggatcagcttcgcggctcgccccgccggtgccgcgaagctgccgtcggccttgcgcccgtacgccacgtcggagccgtccggatacgtcaccacgaccgcctcgaccgcgctgttcggcccgtaccgttcggtcagccgggaatcgacgacgttcgcccatgccgcaccgaacgcacccgtgtagcgcgggtcgcgggagttgtaggagcgcacgatcgacagcggcgggccggccgttgccacgtccgcgtccgtcaccgatgtcgtgtagttcccgatcgacgcgtcgaagccgtgccccgggttctgcgagagactcgatgtcaccgctggttggggcacctggacggagagctggtagtactgcgggtcgaccgagtaattggtgccgtcgtacgcctgaaccgtccaggagtaggtctgtccccagtccaatttgccggccggcaccgtccacgcaccggcgacgacacccgagtcggcgaccaccgtgccgccgccgttggcgacctggaatcggaacttcgcctcggacgtgccggtcagcgagtccacggcaccgatcgcggacagcgtcggggtcagcgtgccgaccgacgcaccattggccgggctccggctcagcaccgtcggcagcaggtagccgctgtaggtgagctcgatcgtgggcgtgtgctcggaaatcgcggatgcgaaccacttctgggtcgatgtcgtcgtggcgagccgcaggccgaagtagttggcggcgccggtcgcccagctgttcagcgaggcgacggccagcgacaccgagatgttgtcaccgacggtctggttcttcgaagtgttggcgcaggacttcgggacggccggcgtgctgttgccgatcgaggcggtgaccggcggccccggataggtcatcgcgtcggtgacggagaacggttcggtgacgagcgcgacgtcgaagcgagaggccgtgcaggtggacgaccacacgtcgaacagattgagcgtcgcggccgacagggtcgtacccgaatcgtggataccgagcgacgggaacgtcaggaatgagtagtcactgtgcgccccggagtcggcggtaccgactttcatcaacgtgtcgtcggagtgatccgccggcgggctgttcgactcgacgtacgtcgtgtaaggccttccgttgaacgtcgggtcgacggtcaccggaaacacccgggtggggtcgtgcagccaggccggatccagcgacatgtgcagcgtggacccgctcagccgataggtcacggcgtgcgtggtcgcaccacccggcggcgccggagccgagtcccaggcgtagccggcgggcacagtcagcagatccttgccggccgtgttcctcagcacgatctcaccctgggcggtcatcgcggccgacagtccgtgcaggtcgagcgcgaaatcccagctggcggccgcgttggcggtgcgcagcacgagtgattccttggcaccggtgttcgtcgcggacagccgcaggtcggtgtcggccagcgccccgacgtaggtgaccgttgacgccgtacccgtgccggcggcgtgcgtcgcgccgagcagccgctcaccgacggagtgggcggcgtcgaccgcaatcgaggtcagagcggggtcatcggcgtagggcgcgaactcgacgttcagcgagttggcattctcctgccatcgtccgccgccggccttacgcaccgacgtgtcgatcttcttccagcccttgccggccttgtagttcaccggcccggcgctgacgatccggctgtgcgtcccgtcccggttgtcgtaccaggtcgacgtcgcatccgacttcgccggcaccgccacgctggtcacttcgtcaaatccgtgaaccgccccgccgctaggcccggttctcacgctccggtcccatggttgagcggcggcgagctcgcccttgcctttgccgggtttgcgaccgctcccgcggccggcgctggtggcagccgcggaggcggtgtgcgaatgtccctcagccgtgcccgtcaattcagccggaccgtgtggatgcgccgggccgcggggcgatgcccagcccaccgaggcggccaagcccgacatcagccacgagtagatgccctcgagggagacgtccgggccggataccgccagcgcggcatcgtcgggtggcgccgtctgcaggacaagaccgatgaccagagccagggcgagaacgaatacgccccgccggacgaacctacgcaagaacgagccgagccgtccgttacgcacagcaacccccgcgctatgcatcgacacagagcaatttagggagtctgcaccaccatgatctcccggcacaaggaggaatgatcgatctcctacggcgacaatccgggcgtcaaccacacggcggcgagccaacatcttcgtcggaggtcagaaagtcgggaccgcagcctcgggcggaccgcaaccggcccaccctccgcgcccaccgtaacgtgaggcctgggggtcgccccgaggcagatacgagtgggccggacgttgcactatgcgaaccgccctacgaccgtctccggccacccgctgccaggacgtttgaccagctcacggggcagaatattgcggccgggggacgccgaccagtgatcaccgaaccgcgctagggtggccacatggccgaatttcgcacgataacggtgccggtcgtcgtggagcgcgacgaggacggcgtgtggtgtgcccacgctcagttgcgccctggcctgggagcgcacggggaaggcgacaccgaggaagccgcactcgaggacctccgcgaggcgctgaccggcctcatcgaggagttcggcgtacctcgcgagctctctatcaccgtcgcggcctgatgcccccgctcccatctatctccggcacccgcatcgtccgcgcattggagcggcatggcttcaaggtcgcaagagtggccggcagccaccacatcatgcgacacccggacggacgtggaaccaccgtgccagtgcacggcaaccgcgacgtcgccaaaggaacgctgcgtggcattctcaacgatgtcggcatgacgatcgaccaactcaccccctgatatcgccctcttcccagaagggatgcgccgcggccgcggcgctcgcaggcggagccaataagaagatcaagaggtcgaccgctcgcgtacgtccatcatcctcctgagcacggcttacaaggctttgcaaggatgcgacgatcatggggatcacccgccccaaccacgaatcatggtcatctcggtaacgacgacggtgcctgcgcggcccactggcgaccccggacagattgccggggccaccattcggccctacgacttgcggagtgccgcggcgatccggtcggtatctttggacgcgatcgcatcgtggatctcggtgatcacagcatccttctcggccgctttgatgaccttcgtcaagttggcgcggtcggtgtagagggaacgggcaagttcggcgatcggcaggtcgacgttcggcgcgcgctcggtgatccgcgcgtatccggcgaggccgattttaagagagaagcgggcctggttgagttctgcctcgcccgcctcgcgcatcagccatgcagcgacgacgttacgcaccagcccaggtggttgcggcgtgtccgaggccatggcctcgtcaccgcttccaaattccagggcaagttcgttgagccacttggcgtaagtgccatacgcgtcgagaacgttgtaggtgtgcgtcgtttcgatcccgccgttcgccaaggttcggataatcgtcgactccttcgggccgacttcctccggcacgattgccacaacccggtcccgccacccacagacctggctggcagccccggtacgcaggctttgggcaaggaagaggcgagcaacgtcgtcccacatgtcctcccggcgggttcccgccggaaccttccacacctcggacggcggcccaggctcccagccaccatcggcgtccatcgcgatgtcggtctcggccagcacggtctcgcccggccccaccgtctcagcgacgacgcggccagcttgggagatgaacccgaggaggtgctcggatgtgtcgacatcgaccaggtcgccgaggcgctgccggtcgactgggtcattcaccgcgatggcgtgccgcggagtgagggcctcagcgagataccgaagatcagcgtgtgtcatgggtacacagtacacacccattgaatgtcgtcaaggtccacttccgcggcaccgtgaggaacgacgggccggtggcggcctgcacggcgaggtcgccgggctgcgctgggcagacctcgatctcaacaaccggcagctcacatcaccaaccagcgcaccaatgccggccaccagatcatcgaaggaccgcccaaatcggcggccagtcgctgcaccattgccctggaccggcgcaccgtagccgtgctccggagccatctaagccaccaacgcgcccactacttgcacacctgacacacatctagctagctaggcagctttttcattgattagctccagtgcgagttacggactttctacgcgcaccgtccggccccgtccaactacatatcgctccgtccgggatgctaaatgcaacctcaagagcacctgagaccgcaaaatctggctccgtccgggtgcatccgatgagggtgcggaacatccgagcgaccacggagcaaccggacgacctacatggcggcgcgcgtctgggctgcgcacgggcctgacatcgccagcaatccctctcaagtcccgccattgtcgttagcggcaaagcggccgaagcatttgatccgcaagtcgcagcagaccataagacgcctcaataggcactcagggcgccctgggagacgatcgaaatcatgtcatcccagggcgctctgatagtgacggtcgtcgcaggatccggcgtcacagtatctgcgtactcattccagcgaagatctatcatgcaaggaaggggtcatgccttccgtcgtcggtaacgagcgggaaccttcgtcccacaaagtcgaaggcttcaacccatcggacgctttcgggacgatcacctgtacccaggcggcagaactcctcgacggcctgccgtacctggtggagcggaatggtgcttcttggatcgtggcattcttctacgtcctgatccattatcacgccggtgtcgaactccggcggctctacattatccgtcacccagacgctggcatgtatgccacccttccgcggaaatgagacctggtcgacgcaccagacgagggcaccgtatccggtcgagtgattgcaagcaacacttaggaagttgctaggcaggccattacgaccggcttcactactctgaaggtcgtggcaccggtccgaccatgagagctcgaatattgcgtccgttgccgtaccgtcatctccatgcgcaacattccctgcagacttgctgctgcggccatcaaaaatctcattaaccacagcagacaccgcctctgcagtctccgcgcatcgatgacgccgtccgtctgaaaagttcaaaatcacgcgtctattcctcattccctatcgcgaagctacgccttggacagggtatggctccgcccgccccggccaaaagacacttatcttctggtcgcgatagagaatgttcgccatatcctgaaggcatccaagatcgtactttactcctccgcaaggaccgttcttgttattgataatcataatcccgtttttcaactcttcgctggtgaatccgctatttcgatattctagacgcatccaccaggccagcttcccgtcggcgtgccatgaagccctgaaggtcgtcttcgcgggaacattcgggaagattttatggaggtaggcgttaatatacttggattcttcctccgtgcgagccgacaactccgcgacgcgccgcccaccaacgtacaagaagcccgtcgtgactggaagtttcctgtccgtcatctccctaagggcgtctgccacccaaccgggaggacaagccgtactgttatgtaccagtacgggaaggccgttgttgtcaacgaaataggtatgcaggccttcgattgtcaggtcataggtggccatcgcgccggtataattccgcacagcggcgaccgtgatcgttcccgagctgccggtcctcagctgatctccgacggcaagatcgcctgcgttgacgaattcggcgcgagtgacgtcgtagaatgggtggttctgagtgccgacaatattgactcttctgtcgccggccacgacggtcagttcagtgaattcggtgtccgtagttgtccggtgcgtctgcgtcacctgatgcgtctcgacgccaccagaaggtgtggcgttacggactaaatcaccgactctgactgcctcaattggcttgactgtgccgtcggccataagaactccggtgccctccgcgaaactatgtccaccgaggcactcgagaatccgcttttcgagagcttcagcacgggcagcagccgcgatcttctgaagctctatcagggtctggtactcaatcttcaaagccttgatcgcgttgatcgccccgtcgattccttcgacgtcgtaggcgatcatggcgatgcgaagcgcgcggagtgctgtcgatgcggctttgatgatctccgcaccgaaaagttcaccgacgaccagcccgcagtcgaacagactcccaccgtcgtcggcggacgtcagcttgtggtagcagccgatgaattcatggaacagcgtctcaggtagatgtttgacgtaggtgtcatacaacgccatctgatcgatgtgatgcgtgatcttgtacggcggctggttgatcggaatggtcgccaacgggtacaggttgaggacagagccgctcgcggttgtgaaacagtggttcgggtccgccgggtcggggacggcgcaggcggcatagaagtagacgttgtagccggtgacgtgggctgtgccggtgacgtcgcagccgccgacaccgacgcaggggccgtctggggtaaaggtgaccttcgcttcaggacggacccagataccgtcgccgagcggcgacgccttggcgttcaggtcagttagctgctgcgggtcgttgaccgtagccgaggccagggcagcgccagctgcctgagcaccctcgagtgacgtgttggcattctcggcggcttctcgtgctgcctgcgctgaagcttccgcatcgtcggcgtactcgctggcctcgtttgcggagtcctgcgcgctgtagtacgcgtggtgcgcagcgtcggcgtcacgttcgctctcgtcggcggctgcttccgccgccgtcgcatgggcgtcggcggcatcggcggagccttgggtcttggtgacgtcctgctgggctttggcatccatctcgtcgatgcgcgcggatgcctgcttagttgctttcgcgtcggctgctgcttggttagcagacttcgtggcggccgccgccgaggcggctgcctgcgatgccgagaccgcggctgcggccgctgcttggagggcaagtttcgcatccccgctcgcccggttcgcggcgtcctgggcatccacggctagagccgccgcctgagtcgcctgcgctgcggcgatattcgcctgggcggcggaaatggtctcggctgcttgtgagctcaggccggccaggccggccgctgaatcggtggctgcccatggcgttgcaagatcgatcgcggtgtccgcgggggccgctacagtcgcggctgcgaccgcggtttcttgtgcggcttggccggtggccacggcttgcccgatcgcgaccgcactgtcggccagcgcatccgccgcttcggtctgagcctgttgcgcggctgccttggcactgtccgcctccgccttggcgtcggctgccgcctttcgtgcctgtgctgcctgagaggccgcgtagcgtgcgttgctgatcgcgtcggcggccagcgcgtggccctcgactgcatccgcgtgggtctgcgacgctgctgccttcgcagtctccagatctgcggccgcacgctgtgccgcggcgcgcgcggtgccggcagccgatcgtgctcgggatgcggcggcttgagcggcgtcggcttctgtccccgctgtgtcggcggcggctgcggcatcgtcggctgccttgcgggctttgacggcctgagcttcggcgtcgtcggcagcgtctgtaccggcggcggcggccgccttcgcgtctgcttccgcggctgcctgcgctgttgcgaccatctcggcctgggccttagccgcccggcgccaagcgtccatcgcgaaggtttccgcgagttttgctgccgtctcgtcctgaccggccttggcggcagcgctcgccgcctcgttcttctttgattcggcgatcgcggcttgattctgggccgccgtcatcgccgcggccgcgttctgccgttcccgttcggccgtcgcttgggcgtctgcagcaatcttttcctgcttggcggcgtccgctgctgcagcgtccgcccgggctagagcgcttttcgcgtcggcttcgacagtggcaatcttggtcttgtccgcagcggccttggcggcggcggtggcggcctccttctcctcttgctttgcctgcgcggcgagctgcgcggcgtgagcggcgctgtcctcggccgactgacgtaggtagagggcgcgggcggcgtgcgcttgcgcgcttgcgtttgccagcagggtggccgagttagccagcgttgcgttgactgcagcgaccacggtttgcatcgcgttggccgttgcctgtgtggcggcggctgctgcctgcgcgacttgtgctgattgctgggcgtaggtcaggccgcggccctgcggtaggccagctgcggtcgctgtggtgtacgcggcgtcacgtgcggcgacggctttgtcggcagcgtccttggcgaccgcggcagagtttttcgctgcggcggccagggcggcgactttagctttgatcacgccgaggtcgtgcggggcgcgggagatgtcgacgccggtccaggcgggtttgccgctgttgaatttctggtcctgggcccattggatgccgcgagcggtccaggcgtagccgaggccgtcgtgcatggtttcggagctggcgcgcagggcgtccaggctctgcatttcggcggcgaggatgtcggcgcggggctgggcctgcgagttgagttcggcctgccattccgcccaggcggtttcctcgacgtcgagcaggacgtggtcggggtcgagggggttgctcgggtcgccctgtgcccaacgggttttgagggcttcgacctcgatccggaattccggggtattcggctgcggtgcgacccggggatagctgtcgaactggatgaaccggcgaacgtcgtcggctgacccttctacgacttttttgatgttgtcagcggtgaagtagccgttgcctggctcggacttgaggtgacgctcatagatctcccagaccttgtcctgctcggccttcgacgcctgcgtgatcagagggtggaagtaggcggcttcgacggccagttctctcgtcgaacctttggacaagaagttggtgacgtcggtgtcaaaggacggccgggatccgtagtcgcccatcgggtagccggccaggaacgcgtcgcgggcggtctcacgctgctggcgtgcctgatcggcggtgccggctgcgacgatgtccgctcctagcgggccggctggcgctgtgtcgctggaggcgtcggcccatttccagccgttgacccagtcttcggcgatccagtttttgtcgacccagtcgccccattcgacgttcagcgccgtgtcggggccggcaagccactgcgcggctatctggcggacgttggggcctccggcgtgcataagcagggccaggtgggcgcgggtgtcgcgtactcgtgccgcggtttgcatcgcgacgagtcgttcggtgccggttcctgcggggatcaccgtggtggtcgcggtgatcggtccggcgaaggcgtgcccggtgtgcgggatgctccacacctgggcgtccccgttgttacaggtggcgatctgcagtggggtgccggtggtgaggttggcgttcgggtcttccaggcatcgcgcggagttcgggttgatcagttgggtgcggccggtggtgtcgaacccgacgacccactgctggtcgagggttccggcgcacttgctcatcgtggtcttggtgccgttggtggtggcggtttcgccgccggtgaggctcaggcacatggtgccggccgtcagggtgccgtccttgttgagagtccatgggaggacggggccggtggtgtagccgacgccgcacgggttgatcacgaccgcggcgcctgtgtccggggtgctggtcgtggacgccggcaccgcgcatttgttcaccaccgggttggtgatcgggccggaaggcgggggcggtgtggtggggttggtgaactgctggccgagtgagccggtgcaggtggcgatggtcagcgcggtgccgctggtggtcgagtcgttcggcgtgttgaggcaccggttcgatgccgggttacgcagctggatgctgccggacttgctgtactcaaacacccagccttgattcgcccagtcgtggcagtcgtaaagcttgactggaacgccgtctgcagaatctgccgtcggatccgatgcggagacgtagcggcctctcgatgcggccgtgcgtgctgagacggtcccggtgttcaggatgatcagccgcccggacgagccgaccgcgatcgcggtacgccccactacatcggtgcccgtcaggacaggcccgttctggactgtccaagtcgtgtccgatgccaggcgggcatacgcgttgccgtcggagccttgcatcatttgcgtgcggtcgctgtcgaccgtgatcaccctgcgcaggggcgacgctggggcagtgaccgccgcgccgctggccgaggtaacggcctctttggtccagccgttgagactgatacccgtcttgacatagacctcgctgcgggcgtcgaccagcatctggaggccgccgttggtggcgatcgcctgcgcgcccggtccgagctcctttacccagccgctcgcgttgccgatggcggagcgggcgtataccgacccgtcggcgccgatcatcatctgagtgccgtcggaccccacagcgatcgccttggcaccgccagcggcggtctcggctacccagccggtagcgtcgccgatgccagaccgggcgtataccgtcccgtcggaggccaagtacagctgggtgccaccgttcgtggcgatcgcggtcgcagcctgcgtgccctcgttggtccagccgtcggcaccgacattattgcgggcatacacgtgccagtccgcgccgatgatcatctgagtgccgtcggagccgccggcgatatcttggaccttggcgtcggtctccttaacccacggacccagctcggcatttaagccattctgggtcctcgcccagacttggccatcgtcggtcaaaagcatctgggcagcgccggccgccgccacttcgcgagccggtccgccattacggctcaccacgctcaagcaactggtgggcacgccagccggagtcagattcccttgcgtgctgaacgtcggaggcttgaaggtccacatctggccggacgcgccggtgcacgtcgacgaggcggctaccgtgccgttggcggtggcgccgctgacacgctccaaacaggtcttgagtccatcgttccggaccactcccgtggcgggtgccgtcaggtctgcaacctgcgaggccgaagtgttgcctaggttccagtccgtcgtggctgcccatgccgccgaggcatcagccgtcgacagaaccattgcggccacggtcgttgctacagtggcccgcatcacataacgggcccggacaaagttgaacagccttaagcgcacgacgcgacgcgtcatgatcattatccccccgggtaaccatgccgccgatggcagtcgtggactatcgcgagcaatcgacgatcttgcttgcgccgagcgtaagcatgccgccacgacggttgcaatagacagcgaagatcatggctctacttcaagacattggacctcgacaaaggcaatcttaagaacttaattggacatagctattgccccgccatgcgggcttgaacgggtaatccgggtgccgtaacgccgcagccccgccacaacttccagggttttgcgggtggcgatggctcgcttgccgcggggaacaacgctcctgacgcagtcccgccagcggtacccgcccggctgacggtgatcaaaacatctgaggcggacagtgaagcctgtgtgaccaggccgcatggtgcgaggttgtcatgaaaacgccggggctgttcaagcaatgcgggtgccgcgatgccggcacccggcagcggctacgtgcccgctgcccgcggatcggcgagcgcgggcacggcacctggtactaccgctgctacatccgcgacatgctcggcgagtcggtgcagatcagtcacggcggctatcgcaccctgaccgaggcccggcaggcccgcactgccgtgcaggcggagtcccgcgaacagtacgccggccgcacctggacgatcgcccggtggctgacctactggctgaccacccgaaccgcgatccggccgaccacgcacgcgatctacacccggcacgtccatcagttcttgatcccggcaatcggctacctgcggctcaccgaactcaccagccggcatctgaccgcgatgttcgccgaactcgccgccggcaccaccacgaccgggctaccccgctccccggccaccctgcaacgcatccgagcaaccctgcgcgccgcctacaacgccgcgatccgggaagggatgatcaccgacaatccggcccgccgagtcgagataccagccggccgccgaccccaggccgtcgtctggaccgaaggacgagtcgaagactggcgaaccgacggcgcccgccccagcgtcgcggtctggaccccagcccagctgaccgagttcctcgagttcgtcgccgacgacccgctgtacccgctgtggtggctaatcgccctgcgcggcctacgccgcggcgaggccgccggcctgcgctgggaagacctcgatctcaacaaccggcagctcaccaccaccaaccagcgcaccacggccggctaccagatcatcgaaggaccgcccaaatcggcggccagtcgccgcaccatcgccctggaccggcgcaccgtagccgttctgcgagaccacctgcgccaccaacgcgcccactacctgctcaccggccgcagctctagctagctaggcagcccttgcattgattgcctccaatgctgactacggactttctacgcgcgcagtccggccccgtccggctacataatgctccgtccggaatgctgaatgcaaccccaagagtgcctgcgattgccaaaatccgactcggtccgggtgcgtccggtcaggctgcggaacatccgagcgaccacggagcgaccggacgacctacatggaggagcccgcatgtgggctgcccaggatcctgatctcgttagcagaggacgtccggcggctgcttcgctccccaccttcgggccggactggcatgtcggtaggacgaaaacagctcctcagcctgatgcttctgcaacggtcactggctgcgcgtcccattctggtggcagctgggcgaactcggctccaacaaacgaattccttcccggctcgttcggcgagatggtgactcattaccgatcgagataggaggcggtaatgagttgcaatgaggttgagggcgtctttcgccgttgcgggtgcaaggacacggtgaccggccggcgattcgacggtcgatgcccgaggctggccgatcccaagcatggcagctggtacttcagcgtccagctgcccgatgagcagtctcggccgacgcggtttcgccggggcgggttccgcaccgctcgccaggcgcaggccgtccgtaatcagacggtcgcgtctgccgctgctggtgccggactgcggcgggtcacggtcgagcagtggttgcgccgctggctgctgagtctgcctgggcaggtacgccggtcaacggctgccggctacagcatccacgtgcgccggtacctgatcccgcacctgggccaccacaccctgacagggctacgagctgcgcatatcgaggcgatgttcaccacgatcaccgcacaaccgagccgcaccggcgcgccgctgtcggcggcgaccttgcagaagatccgggccaccttgcgccgggcgctgaacatggcgatccgggagcagctgctggcaatcaacccggcccggctggtgctgttaccgcggccacggcggcaccgcccacaaccgtggtcggcctcgcgggtcgcggcctggcaggacgacggccacaagccggtggtggcggtgtggacgccgcagcagctggccgagttcctgctcttcgtccgggacgacccgctgttcgcgctgtggtggctggcagcccttcgcgggctgcgccgcggcgaaatctgcgcgctgcgctggaccgacgtcgacctcgccgaaggcacgctgacggtcagccacaccatcgcccacgctaacggccgtccctattgggacacgccgaagaccgctgcggggcaacgcaccgtggcccttgatcgcatgaccgttgcggtcctgctacggtcgcaacgtcagcagcgccgccggcgggcagagtgtgccggcgagcggtggcagccgaacgggcccgtgttcacccgccagggccgggcgatccggccggactggctgacgcaccgcttcgccaccctcgtggacgcatccaagctgccaccgatccggctgcactgcctacgccacggcgcggccaccctcgccctggccgcgcacgtcgacctgaagaccgtgcaggacatgctcgggcacaccagctacgccttcaccgccgacacctacgccaccgtgctccccgaccaggcgaaacacgcggccgaatcgacagcacggctcgtactcgatgcgttgaatgaggcgcgccctgccgtgggcgccaggctagggcccgggctcgcgacggcgtcctcgtaggggctgtgctgcggccggccgagccgctaaagggcgcctgaaatgagcccgcgctatcgtgggcgccgtgaccagcgcagccgcggcaacgatcgggcgtaccgcccggatagtgctgctgttgtgcaccgtgttcggcgtggccatgatgcacactttggggcattccggggtccgccccgaacactccagtgcagcggcaatgaccaccatgttgtcgaccgtggccataccagcgttggctccttccgcagcgacggatgaatgccaggacgatcactgcaccgggcatcatcacgatcagatgaccgtctggagtgtgtgcctggccatcctgggcgggctcgcggttgtcgtcctgctggtgatggttttggtggcggccgcccaccctggctcggtaccgcgaagccgtgaatggtcgcggcgacaagcaacacgagcgccccctaccgcgggtgctggattgatcctcgttttgacagcggtgctgcgcgtatagaaattcttctctcggctatggcaacccgcggccgagaaatcacgtgcgcagatatccgttttctgttcgaaaggtcatatccgtaatgttgcgtacctccatgctgtcttcttccacgtggcgccgtagtctgctggccggtgccgccgtgaccgctagcctcatgttgtccgcctgcggcggtgatgacacctcgtcggactccggcatgaaccacggcggcatgacaccgaccgcgaccgcttccgcgcaggcagcggcgacgttcaacgatgcggacgtcatgttcgccagcatgatgatcccgcaccaccagcaggccgtggagatggccgctctggccgacggtcgcgccgcgagcgccgaggtcaaaaacctcgccgccaaaatcaagtccgcgcagcagcccgagatcgacaccatgaaccagtggctgaccgcctggggccacccgatgccggctatggccgcctccggcatgccgggcatggacgcttccgccatgccaggcatgagcgcctccgccatgccgggcatggaccacggtgcgatgcccggcgccatgtcgcaggccgacatggacaagctggccaaggccaagggcgccgcgttcgacaagcagttcctcgccatgatgatcagtcaccatgaaggcgcgatcacgatggcgcagcaggaggtcgcccagggcagcagtccagacgccaaggccctcgcccagaagatcgtcaccgatcagcaggcggagatcgtcacgatgaagggcctgctcagcaagccctgacatcgtcatccacgccgacgaacccggaccgggaatccgacgctacgcacatagctcgctggaagcagcgcccggtgctgtgcgcaaccgcagcaccgggcgcgtttctggccgcatgagcgacggcgtgacaaccctggcctctgcctatctgaaaggtttgccccgaacatcatgatgcgtaccttcgtgctgccctcgatcggctggcgccgtggcttactggccggcgctgccgcctgcgccgtgctggcggtggccggctgcggtgacaccccgacggccggtcccggcccgacgcatgccgccagcccggctgcggccggcgcggcatcaactgcggggttcaatcaagccgacgtgacgttcgcgcagcagatgatcccccatcaccagtcggccatcgccatggcgaaaatggccaccggtcacgtcggggatgctcgcgtagcaaagctcgccggccagatccaggcggcgcagcagcccgagatcaccaccatgaaccggtggccggcccagtggggaaaacccatgcccagcgctggcgctgatgcgatggatgacccggaccacggggagatggcgggcatcgacgaactcgacatgaccgccctgatgaacgccaagggcaccccgtgggacaaacagttcctcgcggtgatggtcaaacaccaccaggctgccgtcacgatggcccagcaggaactcgcccacggcctcaacacggatgccaaggccctcgcccagaagattatcgacgatcaacaggcgcagatcaccgagatgaagcagatccgcgccagcctgtaggccttgtgtgtgatgccggtccggcgatgttcgctgaggccgcggtggccgggcgagtgcccggccaccgtgctctgaccgccccggcaccgtcgcgaccactgttgctgctggcttcggcggccgacgtatccgcagaccaacgtccggtgtcgctgcgggctacatcgaggtgacgtggcagtagtcttcaccgccagtcttccaagttgacccgaaagaggagataaatccggtaaaagcgtctcgtggctttcgctacgattaggccgacctctgttcggtgtgatctcccggaaagttcgtgatgctccagctggtcctgcgggtggtgacggtggcgttgatgctgctgtgcgccacctcagtcgatcactgtggcttggacgccgagcacagccagctgacctcgggcgccgcgagcatgcaacaggatgctgctaccgcgatagcactgctggacagctctcacccgtcctgcagccttgccgagcatcccgcacaccggtgcgagatggcctcgaagctgccggacctcgacggactgaatccgcagttgtcgccagatctgctgaccccgcctccgggcctgcgcctgtctgccggtgcgccggcctgcgcgccaccggcgggtgctgcctcggtgttgtccagaatttgcgtctgccggacgtgaccgtgcccgcgccgacgtcccgcccgcgcgagctctcctgaagctgcgcccggcatagccagggcctctcgagccgtgggccgtgacgccggcgcctgccatgacttcgtcccgcgctgaccgacacccctcgacatcgggtgccgggcggcgacccatgcgcaggaagcgacacccgtcatgaccaaccagaccatcacccggcccaccgggctgcccacgcccagccagctcatctctcactccacctgccatcaacttgctcaactcgtcggcaataccccggtgatgtggattccggacatcgccacgccgtctggtcacggcttctgggccaaactcgaagggaacaatccgggagggatcaaggaccggcctgggcttcacctgatccagcgggctcgggaacgcggcgacctcgccccgggtgccccgatcgtcgaatcgacctccggcaccctcggcctcggactggccctggccgggcagatctaccaccacccggtcaccctggtcaccgaccccggcatggaaccctcagtgcgtaacctgctcactgcctacggcgcccaggtcgacatcgtgaccgcgccgcaccccgatggcggctggcaacaggcccgccgcgatcgcgttacccagctactggccgatcggcccggtagctactgcccagaccagtatcacaacccggacaacgtcgaggcctaccagcatttggccctggagctggtggcgcagctgggccgtatcgacgtgctggtgtgcagcgtcggcaccggcggccacagcgccggcaccgcccgggtgctgcgcgagttcttcccgcacctgcgcctggccggcgtggacgccaccgggtcgacaatcttcgggcagcccgcccgaccccggctgatgcgcgggctgggcagcagcatccacccgcgcaacgtcgactaccccgccttcgacgaggtccactgggtcgcaccggccgaggcggtgtgggcgtgccggacactggctgccgaccggtacgtcagcggcggctggagcgtcggagcggtcgccctggtcgcctcctggctggcccgcacgatgccggacgacgtccgcatcgcggcggtcttcccggacggcccgcaccgttacgccgagaccgtctacagcgacgactactgccgccagcaccacctgctcggtccggcaccggccgccgatcccgaccacatccggcatcccgccgagcgtgaggtcacccggtggacccgctgcacccgcatcatcgacccggccgggcaggatgcggcatgaaggcaaccatcaccgcgacccgctcgttctcccggccggtgcagctactgctggtcaaccagctgaccatcaacatcggcttctacatgctcatgccctacctggccggctacctctccggcaacctggcgctggccggctgggcggtcggcctggtgctgggcgtgcgtaacctcagccagcagggcatgttcctgctcggcggcagcctcgccgaccggctcggctacaagccgctcatcctggccggactcggcttgcgcgtcgtcgggttcgcgctgctcggcttcgtcgacaccctgcccgggctgatcgtcgcgtcgctgctgaccggcctggccggggccctgttcaacccggcggtgcgcgcctacctggccgccgaatcgggcgaccgcaaaaccgacgcgttcgccgtgttcaacgtgttctaccaggccggcatcctcgccggaccgctgatcggcctcgccctgctcaccctcgacttccggtgggtgtgcctggtcgccgccggcctgttcctgctgctgctgatcgcccaaacccgcgcgctaccggcccgccgggcggtacccgatcacagccggcaaagcatgctggccgactggcggcaggtgttcggcaacggcccgttcctgctgttctgcggcgcgatgatcggctcctacgtgctgaacttccaggtctacctcggcctgccccttgaggtccggcgcatcaccggccacgagaccggggtggccgtgctgttcgccgtgtccgggctgctcaccgtggccgggcaggtcaaggtgaccgcctgggcgaaagcacgctggagcccgcagcaagcgatcgtgcgggggctgctggtcatggcggcggcattcgtgcccctcacgctgtccgccggagccgggccaggccgcgctggggtgataggggtcgcggtggcgctggcaccggtgctgctgagcacggtgctgctgacgatcgccacgatgatcgtgtacccgttcgagatggccaccatcgtcgccctggccgggcaacgcctggtcggcacctactacggcctgtacaacaccatcgccggactcggcatcgccgccgggaacctgctcaccggcgccgccctggacaccggccgccgccacggctttcctgccctgccctggctggcgctcaccggcctcggcgcagcgtgcgcggcagcggtatgggccttgtcccggaccgggcggttacacgctccggaacctgacctcgattcggccgcaccgccgatgcccgcgcgaaatggttcacgctgagctgcgacggagcgagtcagcggcaggcatcccgcctgccgctgactcgaccgacgcaccgctcatcaggcttacgcgcccggatcggcttgggtgcctcggcgtcaccgatgccggtaccggtgccccccgcgatgtcgtaacctggcccggtgacgcacctccggccgacgagtcttgcagcggtaccgctgcgctggctgctggtggtgctgactctctgcggtctcgggctcttgcaaggcgcgcattgcgctgacaccgtcgcgacccatacgccacaccgcagcgcaagcaccggtacccagccgcacgccgcgacgcgcgcggcagtcaccaccgtcgctgacaaggcgtcgacaggcggtcacacccaccctggtcatgatcatggagtagacgccagcgctgacggctgcgatgaccagacacgaccagccacaatcacggtcgcggcaccggtaatacacctgcccgtcgcggtggcacgcatcggtgccagccagacccgcccggcaacaccacggccccgccactacagcacggtgacactgacccatatcggcgtcagccgcatttaggacaccggccaagccaccttcccccgttggtggcagctcactcggtcatcgcggcacggctgccgcttgcagccgacgccgccgcaccgcgcgtacgtggtgcagtcctgatactcctcgcgctgaaagccgacccaccatgacttcctctgccaccatgcccgcctgcggcctcatccccaccgcggcaggcagctaccggcgaaaccggtatgtacgcctgtcgcacggccgcactgatcccactaccgcagcccacccgcacaacaccccgcgcagcgacagctccgccaccggcctaacagccgcccggcaccgcggttcggtggtgcagccgtgagggaacaaacgctgccaccggtccggaccagccacctctggcggggcctgcagggccggtggaactacgacatgtggggctgcaacggacggccggtggtactgctgcccgcggtgctgttcgaccggaccatgtggtggccgctggccgccgagttgcgcccatacgcggcggtgatcgccatcgacctgcccggtcacggcaacagcagcgacacccgggcgcactacgcgcccagcgacctggtcgacgatctcgccgacttgatctacagcgtcggcatccgacgcgccccgatcatcgtcgggcatgcctcgtctaccggcctggcgaccttgttcgccacccggtatgccacccatgcggtcgtcaccgtcgacgccggcgaccaagcctcgccaacacccgtcgaccgtgagcaatacctggccaccatgcgcctgcaggacatacccgccgagttccagccgttggtgcagcccagcgacaatcctgcactgctcgcggcataccagccgctccttagcggcaccgccgcgcaggcaccgggcgccgtcacggcagcgctagccgtgcacagcaccagcccttcgcccggatgcttcgacactgcaccgcatcgctggcagcaccacgtgtacaaccggcccggccggttcgcgcagctgtccgacatgcaccgcctgagttcagacatccaggcactgctgtaagacgcagagccatcagccgggcgtggttactcgtgcgccgcgcccggccggtccaccgtcgggcacgtcctcgtcatctacggtgacctgagcacggggccacccgtctgttccccctccgagcttggttgtcacgggccggacggcagcggtggcgtatcgatttccttcttgttcgcggcgtacttgtcgcgcagcgcgatcacgtagctgatctacgcccgccgcgagctgaccaccacgtcgagaccggcccatttgtcggtcaggtcgcgagggttgccaaccagcagctacctcaacctaagttgatcgaccgccgtcacgggtcgaccttagcctcgctcgggcagccgttcttggcctgccaggtgctgatctcggcggccgctgaccgttggccgccggtgcgccacgagtcgaggtatggccagggccagatcgcgccgcgctgggtgtaccagtcggcgccgcgtgcgcagggcggggagataccgaagtgcacgtggcaagcggtcgtgtctcccgtcttgccggtcttgccgagtgtctgcccggctttgactcgcgtcccggggctgatccctgggctgatcgcggacaggtgggagccgtagtagcgcacgccgtcgtcgccgacgatcgccaccgacaggccgcctcgagtggggccgaggttggctttggcggtccaccgatcgacggtgttggtgaaaatgacaacgccgttggtcacggcgacgaacgtgttgccgcacgcggtcatcaggtcgctcgccgggtagtcgtggtggctgtgtgcatacgaattggtgccagccacggggaacacgtatgggccggacggggctgcggtcaccgacgagggggtcgggtgtggggacgtagcccggctgacagacgctgtggtgctcggtgccgtgctaggagcagcgtcgccccagactgggtcgggtggggaggagcatccgcttacggccagcaggagggcggcgctgctgagccctatgcgggcatgacggtgacttttgcggcgcacggatgtcgttcctcctggtgagggccggtcacgggagatgggacgtcgattgtccctgcgctggtcgagcagcccgagccatgtttcgttgccagccgagcggtgacgtgcggtgacgcgggatccgctactggccgggtggtgaagaacccgctgtggccggcccgatcgcagttgaccgggccggccacagtatgctcgtcgatctactcgggtgtggtctcagctgggtcgtcggaacccggcgacggggccgacggcgtcgaggccggccatgcgcacgaagtcgccggtgtgcggggcgtgcacgaccgtgttgttgccgacgtacatgcccatgtggtgcagatcgctgtaccagaagaccaggtcaccgggcttgaggtcggcgcggctgaccggcttggtgtcttcccattgccatttggtgtagtggcgaaggctgacgccgacggtggcccacgcggccagggtcagcccggagcagtcgtagccgtcggggccggcgtcggcccagatgtagggcttgccgatcaagctgcacgccttggcagcggccttgccgcctggatcgttggtgtaggtagccgggcaggcgccggtgcgcaggttgccgctggcgccgccgccggccccgtacgccttgacccgcaactgctgcaggtcgttgatctttttctggatggtgttcttcttcgccgccaggtcggcgtcgcgtgcggccaggctggcggtgacggtgtcgagttgcttcttgtcactcgcgtatttgtcgcgcagcgtgatgacgccagcgacttgcgagcgccgggagctggccatcacgtcgaggtaggtgagtttgtcggtcagatcggcggggttcccgctgatcagcaagctgctcagagctatgtcgccgccctgcatgtaggcgcggctggccagctggccgacgccggacatggcggcatcgacccgggcttgcagcggctgcagctgcttggtgagtttctgctgctggctgcggctggtctgcagctgggtgtgaacctggttgtactgctcgatggtcggctccagctggttccactgctggtcgagctgtttctcgatctgttgcggcgaggggttggcgcgggcaggcgcggtcatgccgagactgaggaccgcggcgagcagggcgacggtccagccgcgccggcgtagtgccgcggcatgtcgggtggcaagcaaaaggggggtcctttcggggtgctgccaggtcgtcgtgtcactggacgcggctctgtcgagcgcgggtcttgatcagcaatgtgccgggcatgatggtccggcccgttgttcgacgtgggacagcttcgcgggggtgatggcacaaggtgcgctgcgttggtgggccgccgcgggcggcagccggcaggcttgttatgtgcgcaagaccgcggtgctcgcgagcgtgagcccgaccggggctcgggcctggccgacaggtgtgcgttggtgcgcacttggccggcgggacccggcgatgggagtgggccgggtggcggtgaccgccacggcgaccgcgacggggcttaggatcgcctggcaaacctgccagctgtgccaggcttcgcggctggtgccgaccagcgcgctctgcgtacagccgtcgccgtcgcagccgccgtcatcgtcggcagcggcgatctggataccgggaagaactgcgacggtggtggttagcgcttgcccgccgccgagcgggaacatccggtgttcgtcgaggccaacgtcggtgtgcccaagcgtgtgcaaagtcgcgacgccgagggcggtgccggcgatcagcagcagccgcagcagccgccacaccgcggccacccggccccgccgccaaacggccacgctggcgcggggagagcggatggcaccaccggcagccgcgtacctacgcgacgccggcagcgcgatgaccggcatggtccaccgttctccttgctgccggtgcggcgtcgacggatcgcatggctttgcctgaggagggtacggatttcgaaagccaagcgttcaacgggggcgtagatagtggccggtcacttacctgcggtccgggttggtcgctgcgccgacgaaaaggggcagggcgagcagaaaccgatcgactgccgcacgattacgttgctccgccagccaggtgtcggcctgcgcgggcgtgatcgccgcggccttgaccgcagcatgggcgaagccggtgagcatgggcagcatgagcccgccggtgaacacgcccgtgcgcacctgcaaagacacctgctcgaagcctgcgtcgagcagcagcgtccgataggcgcgagccacccgcggccagcgaacggcatcggcgcgggcctgcacgatgcgccgggtcagcgagccgtcatcagcgtcgatcacgatcgtgtcccagtcctggccaagcagcacgatgcggccacccggccgcagcacccgccgcgcctcggccacggccgccgccgggtcgctcagttcatggaacaccttgtcggcccggtacccggcggccttaccgtcgcccaggggtagctgctccgcggccccgacccgcagatcggcccccggataccggctccggccaagagccaccatggcctcggacacgtcgacgccgatcgcggtgacaccccggccagccagctcggccacggcccgggccggtgccggccccgacgtcgatcaccgtgtcacctgtttccaggtgcagcaggtcgtaggagtgctgccgcaaggtgaccgcgtccggttgttgctcggcagcgtcgagcagggccaccatcgcggccgggtcatcacgggtcgtggcgtgttgcgtggtatgtgtcatcctgcgagggtggagtctcaggtcgacctcaagtcaacctctgatgatccggtcctgggcatcgggcaggccgggcagcgcttcggtgtcgccgcgcacgtgctgcggcactgggagtcgatggggctgctgagccccgaacgcacccgcgacggtcaccgccgctaccaccgggccgacctcatccgcatcgcggtcatcctgcgcgccaaggacgccggcctgagtctcgacgccatccaccacatgatcacctgcgacgatccgggcacccggcagcaggcattgcagcaccagcgcgacgctctggccgagcgcatcgcccgccagcaagccgcgctcgccctcttggactgcgccctcacctgcagccaccgggacgtcgccacctgcccgcactttcagcagatgatcgcccagcgcgccggcctggcctgacactggagcagtccgccggtgctgtgccgcgctaaataatcatcgggccggctcagatgcggtcgcggcgggtaacaggaccgtgatggtggtgccgttgtcggggtggtcgcagccggtcgggaagtgggtgccgacgcggtggtgggtgccgttggcacacagtcgcagctcgccgtgctgggcggtgatgatggcttcgacgacggccaggcccaggccggtgcccggggtgctgcgggcggtgtcggcgcgggtgaagcgggccgtggcgtgggcgaggaagccggggtccatacccggtccgtggtcgtgcacgcgcaggtaggcggcgtcgctgtggcggccggtggtgatggtgatcggtggtgtgccgtggcgggtggcgttgtcgagcaggttggtgaccacctgctggagccgggtggcgtcgccgaacgccacggccggcgcgtgctgctcggcgtgggtgttcgggtagcgggccgcagcgtcaacagcgagtgcgccgaggtcgacggtgtcgcccggcgcgggtggcggctggacgccgacggtgagcagtgtgtcggcgagctcgcggagccggtcggcgtcaccggcgacgttgcgcagggtctcctcgagttcggcggtgctgcgcgggcggcgcagggccagctcgatctcggtgctgatcagcgtcaatggcgtgcgtagttcgtggctggcgtcgtgtacgaactgccgttcgcgatccagcgctgtttcgagggcggcgagcatctggttgagggtgtttcccaggcgggtgatctcgtcgtcggtgcgttgcgggacggccagccgcaggccggtggcgccgccggcgatgcgggtggcctcggtgcggtaacgctcgacgggggcgagcgcggcgcgggtgagccggtagctgaccatcgaagcgatagcgagggccgcgaggttggccagggcgagctggccgatcagttcgcgcagggcttcatcgcgctggtcgcggcgcagggcgacgacggcgaccgtcgccgacccgctgacggggtgcacggggatggcgtacaggcgcagggtgtcggcgtggatgggaaacagcgggccgcggtcggtgcggacggcggtcgtgcgggcggtggcgagttggccgctgctcagcagcgaagtgccgttgaggccggtgctcgcggccaccacctggttcgcggcgtccagcagctggtattcggtgccggtggtgacggcgggcgggccgccggaattcaccgagctggtcagttggccggcctgggcgatgagatcctcgttgaggcgcaggtcgagggcatagcgcacgcgcagatagacgaacccgcccgcgcccgtgagcacgatcagcatggcgatggcgaacccggcgaccagccggacccgcagcggcaggcgccgccaccggtacgggcgttgcggttcggccatggtcagccgccgtcacgttcgaggcggtagccggcgccgcgcacggtgctgatcgcctgccgggcgaacggtttgtcgaccttgccgcgcaggctggcgatgtagacgtcgatgacgttggagcgcaggtcagtctcgccgtcccagacctcgtcgaggatctgataccgggtgacgcactgcccggcccggctcatcagcagagcgaggatgtcgaactcccgggcggacagctcgatggcggtgctgctgcggtataccgtgcgggcggcggcgtccagccgcaggtccccggccgccagctcggcgatggccgggtcggccgcgcggcggtgcagggcgcggagccgggccagcagttcgtcgaaggagaacggcttgctcaggtagtcgtcggcgccggcgtccagtccggcgatgcggtcggggacctcgccgcgggcggtgagcatgagcaccggcacccggatcccacgctcgcgcagcttgcggcagaccgccagcccgtcgaggcccggcagcatcaggtcgagcaccaccgcgtcgtagtcgccgccggtcgcggcgagcagcccgtcaccgccggtgtgacgtacgtccgcgtcgtggccggcctcgcgaaggccacgggccagcaggctggccaggcgcggctcgtcctcgaccaccaacacccgcaccgccacgctcccctcgcctgtgcacgttgttgccggatcagtggaccatgcccgctgcgggggttcatctgcctttcatggtggcgttcctacggtgataccacgacccggtgagcgctcgtcctgcgcccgggctggtagcagggagtgcgcgtggacgtgtcgtggtttctcgcggtgaaccggttcgcccgggcgacgccgtggctgcatccggtgctggccggctacgcggtgtacggggtgggattgttcgcattgctgctgctggcgggctggtggcgggcccggcagcgcggccggggcatgccggcggcgctctgggcgccgctgggcgtgctgctcgcggtggcggtgaaccagccgatcgtcgccgcgttcgccgagccgcgcccgtacacccatctgaccggggtgctggttctggtgacccgcagcaccgacccgtcgtttccgtcggatcacgccaccatggccggggccgcggtggccgggttgtggctggtcgaacgccgtctggggctgctcgccggggcggcggcactggtgatgtgcttcgcccgcgtgtacgtcggcgcgcactacccgcgtgacgtgctggccgggctgatcgtgggcgcagtggtcgccgtcgccggctactggctcgcggcgcccctgctgcgccggctgctgacctgggcccgcagcaccccgctacgcccgctgatcgaacgtcgccagccgcacgtgcctatcggctcggcctcctgatcatgatcaccctcgggctgtcgctgtccacgctggcgacccgctacggctaccccgggctggcggtgaccgtgttcgtcgagggtttcggcgtgcccgccccgggccagaccgcgatcatcgccggggccggggcggccgggcacggaagactcaacatcgtcgtggtggcagtggtggcgttcgccgccgcggcatcgtcgccggcgccaccggcatgccctggccccgattcgtgctgttcaacgcgatcggcgcggcgctgtgggtcagcctgtggtcaaccctcggctacctggccggtgaccactgggaggcgatcaccgccgtcgcgcaccgctatgagccgtacgtcctggccgggctcgtggtcgccgccctggcactgctgtggtggcggctgcgccgccagcatcacgacggcggcaccgatcatcaggcgcgctaacctcactttctcctgctcggcaccattattcgcatccaccccaccacgacgaccagacaacccgcccggccgggtgacggcttcatgtggctttcatgcgcgatctataccgtcgctggtcatgagcgacgtgctggcggtcgacgcggtcgacctcacgaaaacctacggcgcgctcaccgcggtcgaccggctcaaccttcaggtcagccaaggtgaggtgtacggggtcctcggccctaacggggccggcaagaccaccttcctgcgcatgctgttcggcctcatccgccccgactcgggcaccctgcgcgtcctgggccgcacctggacggccgacggcgtccgcgccctcgacggcgtcgccggattcatcgagagccccaagttctaccccggcctgtccggccgtaaaaacctgcaactgctcgccggcctcgacggcggcaccagccgcatgaagatcgacgaggtcctggaaaccgtcgacctgcgcgaccggcaacgtgacaaggtcgccggctactccttcggcatgcgccaacgcctcggcgtcgccgcctccttgctgcgggagccgaaactgctggtcctcgacgaaccggccaacggcctcgacccggccggcatccgcgacatgcgcgccctggtcaaacgcctcgccgccagcggcctgaccgtgctgctgtccagccacgacatgggcgaggtcgaagagatctgcgacgacgtcaccatcatgcgcaccggcaccgtcgtctaccacggctcgatcgccgccctgcgccagcgcgctcccgaacaggcccacacgatgcagaccaccgacgacgaccgcgccgcacagctggccaccgcccgcggcctcgacgtcagccgcaacgccgacggcctggccgtccgcggaccgcaacccgagatcgacgccctggtcgccgagatcatcaccgacggcatcgcgctgcgcgaactcgcccgccgcgaaacccccctcgaagcgctgttcttcatgctcaccgaacccgacaccgacacgcccgcccctgagctggccaccaccggagcccgccgatgaccgccaccacccttcggcccgccagcgcggccgccacccccaccaacagcggccagcccggcctcggtgccgccctccgctgggaaatcgtcaaactcgccgcgcagatccgcagcaaagccctgctcgccggcgccctgatcatcccgatcccggtcgtcgccgtcctcaacggccaggaacaaccaccctcggacaccatctacggcaaactcatccacctcagcggctacgccatgccgctgctcatgctcgcctgggccgcccaatgggtactcccgctactggccgcgatcgtcgccggcgacatcttcgccaacgaggaccagcacggcacctggaagaccatcctcacccgctcggtcagccgcacccacatcttctgggccaaaacactgaccgcgctcacctacaacctggtcctgctgaccgctttcgccgccagcaccatcatctccagcctgctgatcgtcggccaccagccgctcaccgggctctccgggcagaccatcgcctccggccacgcactgcgactggtcatcgccgcctgggccaccgccatcccgcccgtcatcggattcaccgcgctggcgctcctgctgtccgtacgtacgaagaacccggccttcggcatcgccgcccccgtcgtggccggcttcgccatgcaactgctgggcagcgtcaccgggctcgacctgacccgcaaactgctgctcaccaccccgttcgacgcgtggcacggcctgttcgccgaacacccgttcaccggcccactgctcaccgggctggccgtcagcgccgcctggaccctcatctgcctggccagcgcctacctgtcgctgcgccgccgcgacatcaccggaggctgaccatgcgcccgatcgtcacccgcaccgccctggtgctcgccgtcggcgccggcatcgccgccaccatcgccgccggtcagcccgagatcaccaaggccggtctggagaaggcgctggtaccgaccttcaccaacctgtacatccagcaagccggcatcctcggcattcccgggatcacctcgcagagcatcggcgcgagcaccaactgcgacaagggcggcccgaagatcgccgacaccggcgccggcccgaactgggtctgcatgatgagctggatcgacaaccacggccagcaccaggacggcaaatttgaggtcaccgtccacaccgacgccacctacgtcgccggcggcccctccaaaatcgttggcctggccaccatcaccgacaagcagggccgcgacgtccgcaaccccgtcttcgaattcgacggcgtcatcaccaccaacagctgacccccacaacccgctgcgccccgccccgccgtcaacggagcggggtgcaggctgaccggcaaccgatgagtcagcgacactcggccaggcgcgggcggacgccgacgcccagcaggaccagcacggccacgccgaggactttctatgctgctctccgggaatgcagacgcacagcggttacaaaaaatgggactgtgggggactgtggatctttcggtgtttccggtctgacccgccgggcgtagcccggcgaggaaggtgccgtgatgacaacgacactggacgatgtgacccctcggaagaagaagtcggagccgtcggcggaggccgctgcggcggcggagctggtgcggctggccaaggaacagggcttgtcgctgaccggtccggacgggctgctcaagcagctgacgaaggcggtgctggagaccgcgctcaacgaggagatgactgggcacctcgggtatgccaaacacgatgctgccggcgccggatcgggcaacgtgcgtaacggcagccggtcgaagaaggtgctgaccgacgccaccggccatgtggaaatcgaggcttccgcggatacttcgacggtggcaaagaagaaggagctggtggtgacgccggagggtgtggaggccgaactcgtcggccggctggtggagtaggcccatgccgcgcgactgttggatttacttcagtgtgggcgtgtggctgggtgttggcgtcgggcgagcaggatcgccacgatcgcgacgagtagtgcggcggaggcggcgtagcggtcgaggttgaggccgcctttggcgatgggtttgtcgagaaagtcaccgacgacggcgccgagcgggcgggtgaggacgaaggcggcccagaacagcagggtgcgcgacagccgggtccaccggtaggcggcggcgaggatggccagcagagcggtgaacagcagggcgccgccggtgtattcgaggccgatcgtgtcggcggtccagtcgcccagggcggtgccgagggtttgtgagaacaggatggtcagccagtagaacgcttcggtgcgcggggtctggatgctggtcacggcgatggtgccggtggctttgtaccagagggcgaaggagcacgccaaagagatgaccaggatggtggtgccgccggggtagccgagtcccagggaccggtcgacgtagtcggcgatggtggtgccgagggtcgtggtcgcgacgatggtgaaccagtacacccattggttgaaccgtgtcgcccggacttgcaggatgacggcggccacgaataccaccgcgaagatcatggtgctgaccaggtagcccaggcccatggacatggacagcgagtcgccgcctgtctcgccgagagtggtggcgagcaccttgacgacccagaagccgacggtgacggccgggactttggcgacgagatcgcgcagccggtcttcggtctggtgatctagcaggttcgctgtcagtgggtccgcggcggctcggttggcgggtgttccgggctgcgacatggtgaactccgctcgctcgttgtcgcgatcacgactggccggagatacgcgtgaggctgcacgcgcagttcaaacaggttccaggcaggtcggagagctgcatcatgcaagggtaaatgggatcttggccgaattgcggcttttactcctaaggtatgacttcagtgtgattcgagcccgcgatgccgccggttggcgacggcgcggtatcgccgccggggagtcggcggggatcacccggccggggcggcgggtcggtgcgccccggcggtcagggcagctggccgttgtagtcggggagtttgaacgtgcgctcggcgtggccgccttgcaggtcgctgccgctgttgccgatgttggcgacgatgcgatagccgcggccttcgatggcgatgcgggcgccgcttttgagtgtcgcgtccgggtcgaagtcgaaggtgggccgcaggtagatgtcggtgatcgggtatccggcggaccgcaggttgagtgcggtctgccattcgaggagctcggggcgggcggtgacgaagaagaccgcggcgccggcggcctgggcctgacgggcgagggcgagcaccggtgcggttgccggcgaggtcaggcccgggtgatacgtggtctcgagcgcggtgttgtcgatgtcgagaacgatcgccgccttgatcgaaggatcgggtaggcgggtcgtcaagtactgctgcgccgtatcggtcacggcggtcacatcggaaatccaggcggcgtacgggggcagggcccgcaccgcaacggacgagtgcgcaccggagccgtgggtggcggcagcttgggcagcgacgggcagggccagggtgcagcacgcggtggcgagcagcgacaccagccggaaaccaagacctcgtttcatggtggtcaatctaaacgatcgttacattgatgaccatagatgttttttcgcgtcagcgcaccgaaggcaacgctaacaagatcatcagtatcgcagttagattcgaatcaccagcttgatctgttaccaccgtaggtgcgccagcagtctttcctacagccccacgccgaccgcgacgcgtagaccgatgtgcgcgggtggcggcgccgccggggactgcggcgtcgacgacgatgctggcgtggcggacggtgcgggacgctgcgcgagccgccgtgggtgcaggcggtgagcgggccggcggtgcgcagggcggctgtccggcgccatgcgcgccggcccggcgagccggggtgcggaacacctcgggtgatcgtgccgaccggtcatccgaccaggtctgaaacggtgaccgggtgcaggccgcgagccttcaggccggcgagcagcggggcgctcgccgcgatcgtcccctcgtggccgaagtgcaggctcacgatcgatcgtcactgctcagcggccagcgtcgccgcgacgatggcatgcgtgccggggtcggcgaagtcgcgggagtcgacgtcgtacgacaggccgggaagctcgctcacggtgctcagtcactagtcggcggatacacgtggcccatccgatgcatagcgatgttggacacgacgaagagcacgacggacgctacgacggttgcaccggccgcagccgccgatcggcctcgtagccaggcgatcgcggcaatgctcgccccccacggcagcaagcaggtcagtgaagtcgccaaaaccgctgagatgaagttcggaagggtcatgactgccgtggccagcggtggcagcatcaccaccgccgccccggccgccaggtatccgagacgcttcggtgccaggccggagcggacgccgaccggttcccgccacaccgctgcagcggccaagaccgccgcggcggccgcagcagccactacgacggcggccagcatgacgagagcaccagcaacgacggcctgcgcaccttccgcaaccatctcggctggctcgccgtcctgaccgccgccatagccgtttcctatgtacgcggctacgcgagcccggcatcgctgctatggccgcgcacctccctggcggtgtgcctacttccgctcgccctgtggcaaaccgggccgcgactgacccaaaagcagcgaccacccctgtcagtcagcaaccgcttctggctcctggaccgcaccatgctggagacatcaccaaagagattccgaaagcagccatcaaagaattgctatccgcaggctcggcactcgcacaacagcgcgactaccgcctgccggcgccagccccagctgcggtagatgtgccgtcgcaacgcaccgaatcggccggtcagactccgcagcccgctacggcacctcgttcgcacggatgacctcgatgccgacgtgagcggctggtccctgttcgccggcggcagccgggtgtatgcggttgcgggccacgccgcaacgggcgtgacccgcgaccggcgcctcaggtcagttcgccgaccgggaccgggagtgcagcgggaacactgctacgcgcccggaaccgtccgggtggtcgccgtcccagccgccgtgatcacggtgccagccaccatgatcccagccgccgttgaagtcaccgccgtgccagccgtcgtaccagccgtggtaccagttgtcgtcgtcccactcgccgttccagtcgtcggtggcgacctccagcacccaggcgccgcggttgaacccggaccacacccgtgagcagtcgtagtcgtcccagcgaccgtggaactcgccgagccggcccacccgctcacagccgaaccgggtccggaaatacccgaccacatcggtgtcgtcccaatggccgccggcctgggccgacgcgctgtgcccggccggctgggccgtgacgatggcagcctgcgcgggccccgcagcgatcgccaatgcggcgcccaggcccagaccgcttattgcgagcacacgagtaatccttttcattttccctccgatgaatacatcagttctttcagcaacatgacgtcgcggacagatcggatcacaggccggcaattcgggcgggaattcggatgaccttacgccattcggatgacgtaagaaaatagaatcacaataggaaccagccgcgctggcataaaccctttcggcgatgccgccactgaccgaatggccgccccaggggtccaccgaacggtcagaaaacccgtcggtcatccgtgcgagatctacttcaggcgtgttcctaaagcggatcagagacgctaatagtacgttacggacattggagcgatctctaccctttccgctccactgcatcgtcaccacgcaacccgcaaggggaaggaacaaccagcatgctgaaagcactggccacgggagccactctgcttgcctcactcgccgctactggcacggccgcgcacgccgcaccgtccacgatcgtcccgggcgaggacatggcgatcaccgtggccgccgcgaacggcagcggctgcccggagggcagcgcggacgtcaccgtctcgccggacaacaaggcattcaccgtcacctacagcaagttcacggcccagaccggccccgacgcgaagccgaccgacttccgcaagaactgccaacttgccctgaacgtgcacgtcccacaggggtacaccttcgctatcgccggtgccgactaccgtggttacgcccgcctggagcgcggtgcgaccggttcggagagcgcgaactactacttccagggcgagccgcagtccacccgcatccggcacgacttctccggtccggccgacaccgactggcagcgcagcgacaccgtcggtatcgggtcactgtcgttcctgccctgcggcgaagaccgctacctcaacgtcaacaccgaactgcgtgtcaaccgtggctggtccagccgtaacgccaccagcttcctgaccatggactccaccgacgggcgcatcgacaccgtgtaccacgtcgcctggaagcagtgctgacggcatagcggccaccggcccggggtggtgggcgatcgcggtctcgacggcctttggtcaggttcgcccctagctagggcagccaaccgggtccatcggtgggtcaacgcgggcacctgctcgttgcttgccaaaaaatttggtttggctccaccagccgaacttcttttgggaccaccgcatgatcgagtagaaccgctcgacctccactcgggcagtcattgaggacatcgacggatcgccgctggaggccgcaattccacatgtcatcgccaaggtcgacgaactgatgagtctgatcgctggcgaacgaatctcggctagcgccgaatcccagaaggccagccctggggtggccggaaacgttcaacgcatcctgaacggactcggcttttggcatcacgcggaagaactgaaggtggtggggcgatactgcgtctcgcaggtcctcgtctgtcgccccggccgtcgaaggtgcccccaccgcaatgcacgatgccgcagtgcccacgccgcagacgagcaatcagcgggggtgcaacctcggttcggcgaggcgccacgtcgcggtggctcggaaggcggatttcgctgctgtcggtagcgcatgctcacccggttcgacgaaacgcggcaggggcgaaggcatgagggcgaatccggggagtcgccagtgctcaggtgagccgggtgtcagccgatcagcagaggtgcggacactatctcggacgggactggtggtgtgacccagagcaacaggcaggtgtgtgacacccgcaacgagcctgtcgcgctcatctcccgcatagtggccgagcgtgccgttgagccgctgttccagcccatcgtcgatctcgatacccgccggctggtgggggtggaggcgcttgcgcgtgggccggcaggatccccgctggagttcccggaccagttgttcgaggccgctgcgcgggtcgacttgctgccggagctggaccagttgtgcgccgcccgggcacatgagatcgctcaggcccccggagcggtggtgccaccgctggtgttcatcaacaaggaacccgccggggcggatcggccgctcagcgacgacctgcgattacggctcgcctcgatctcgacctaccgatacgtgctggagttcaccgagcgtgccctggcggcacacccctcggcgctgctcgaggtcgccgcccgggcgcaccgcaccggcggtgcgctggcgctcgatgatgttggtgcggaccggctgtcgctggccttcctgccgctgctggaaccggaggtcgtcaagctcgacatgcacctgctgcgcgacccgtacagcgcacacaccatcgagacgaccgcgctggtgtgcggatacgcccagcggaccggtgcgatggtgatcgccgagggcatcgagacggagcaggatctgcaggtagcacgcgcgctaggcgccggctgggggcagggctggttgttcgcccggcctgggccgctgtccgccgtacgggattggccggtcgacccgtcggctcggttgcgtgctccccgccctgagttgtacgtacccggtgccagcgcgttcgatatggcctcggctcgacactgtgcccgggccggggaccggcatctgctcgacgggctcaccgagtacgtcttgaggcaattgccgttcgccggtccgtacggcgtggtcctgggcgcgtacccgaacctggcgacgggacacggctggattccgcggctggccgccgcggcctcgaccacggcgctggtgggtatttctggtcccggcccgggcctgccagttccttcgccgattcgcacgtcgatcactgatggactgagcggggtggagtcggagtccgccctggtgatcgtcgacccgcatgtcaccgtggctctgtgcacccgacggcgccacgacgatgccatcgccttcgtgctgaccttcgatccggacgaggttcttgcggtggcgcgaacgctgctgcaccggctcggcccgcaggacctacccggttagggacgccgagcgccggacctgtccccgggtggtcatagcactcgaaaatccgcgggttcggtgaggaagccacggccgagaaggactaggcgcaggttttcatgacgaccagcagcccacgaccaggcgggcggtggctccggcgcaccgccaccaccacactcgtcagcagcgagttgtccaagctgtacgcgctgccagatctcgtcgatccgcccctactgagcgagatcgtctgcgagctggccgccggccacgacgcctagcacatggcgtctgccgccgcagctatgggcggcgaacagtggtggtggatccgttgggtcgcccggcaacgacacgtggcgccctcgggcccctgcgatcacgccgacaaccacggtgaagatgattgcctgctacccgcaacacacccggaccggcacagcttccagctcgcttactgacgcggacatgccgccagcgcagagaggcccaagcccgcaggccgattgtggcgtggcggcgcagctacccgggaagcacgacgccgccatcaagggtcgcgtcctgagtggcaagcgaccgcgagacgtgagaggggtatgagctatgactcaggaaggttgcggtatgtccctgctctacgggcggcggggccggcggcatagccggatggatggcgtcatctcgccggcatcaggaagtccagtcgcgggtcggccatgcccggcgtgatttccaggatctcggcgtcgacgacccggtggatgacgaacgggtcggcgtcgacccgttgctgcaactgcggtagggacgtgttgtgcgccagcaccgcgcccccgagttgtggctggatgccgcccacgagcaggaatacctgatcttccagaccttgcttgatccactgctggtggccggccatgtgctcgccggcggcggttttgttttcggtgaaccggagcaagacgatgaacatgcggttcctttacgggttgggtcttggcggatgtgatgatgcgggcggcgggcaggatttccccgaatcgcgcctcatgttgcaggagatctcggccgccgaaggcgttgacgggtgtcgcaaaaccctgctgggaagtcggcgcataggccggcggttgttaacgcggagatcgcgtccgggggttcgtcgccgcatgtgacctcgccgacgacctcgggttggggatctgtttcagatgaggtcaggcgtcgtacgtggggtagtcaatgtatccgagtgggccgcctgtgtagtaggtggacggatcggcggtgttgagagggaggccgtcgcggtagcggcggatcagatcggggttggccaggaacgggacaccgaaggcgatgaggtcggcggcgccgtcccggatcgctgcctgggcgcgggtgaggtcatagccgttgttggcgatgtaggtgccggtgaacgcgtcacgaagagcgcggtagtcgagggcgctggttttcgtcgtcatgtcgccttcgagcgtgtggacataggcgaggtcgcgggtccggagctgttcgaggaagtaccggaagtgcgcctgtgggttggtatccgccatcgagttgaagctgttctcgggggtgaaccgcactcccacccggtgtgccggccacactgcacacaccgcgtcgaggatctcgttgagcaggcgcatccggttgcggggactgcctccgtacgcgtcggtgcggatgttgctcgcatcgcgcaggaactggtcgacgaggtagccgttgcctgcatgtacttcgacgccgtcgaattcggcatcgagcgcccgcttggcggcatgctcgaactgggcgacgatctccggcacttcatgggcttcgagttcgcgcggcgtgacaaactcctgaagccccgaaggggtgagggtccggcccgacggccgtagcgccgatggcgccaccggggtgctgccgtccggcagcaggctcgggtgcgagatccgcccacagtgttgcagctggacgaagacgcgacctgattcggcgtggaccgcctcggtgaggcggagccagccggccgcctgggcctcggtgtgaatgccgggggtgttggggtagccgacgccctcggccgagacaggagtggactcgctgatgatcaggcctgcggtagcacgctgccggtagtgggtgaccatcatcggtgtgacaaccccgtcatggtcggcgcgattgcgggtcagcggggccatgaccatacggttggcgagggtcagatctcccagagggaacagctcgaaaaggccggttgacaaggtgacctccgcttttgtctttccactaggacgggcgtcccagatcgagatattaggacgggcgacctagaagcgtcaagtgcggacgctcttgctgacccgccttgtaggacgggtgacctagccgagtgttaggattgctccctaaggaaggggtgtgcgatgggcggcgccaaggcgacccgagagcagatcatcgaggcggccgatcggctgttctatcagcaggggtacgagcacacctcgttcgccgcgatcgccgaggccgtccagatatcgcgagggaacttttactaccacttcaagacgaaggacgacatcctggcggccgtgatcgatgcccgcctcgccgagaggcggcggatgctcgatcgatgggaggccgaggagcccacgcccgccgggcggatccgcaagtacatcgagattccgcttgccaatcgcgctgacgtccaaatgtacgggtgcccggtaggcacgctgaccaccgaactggcgaagttggatcatgcgtcgttcgtggaggccaacagcgtgttcaccctgttccgcacctggttgcgtgaacagttcgcgttactcgggcacgaatcggaggccgacgcactcgccatgcacgtcatagcgttcagtcagggtgtggcgaccttggcgaatgccttccgtgacgaagggttcatctggcgcgaggtcaagcagatgtctgactggttgaccgcctacgagtaggaccgaaccatccgcccacgccttgagcggcaggaggatttgaatggcccggcctcgcgatcccggttctcagggccttcagccgaccgtcggcggttgccgattatcggatgcactctcatcggctagattcgcgcaccggcccagggaaaggcaactccgcgataccagcccaatattggcgctagctgcggaaataggtagcgagttcggcgggggcaatctgggccgtacgcatcggggtagggccaaggaagcgatgggccctcagcggtgccgatgcccggcgcggtgagaactcctgagttgggcaactgagccgggcgcggtgttacctggcaccggtcggctgccgcgcagcgcgggtgagcggcacggtggcgtcgtcgcgtaggacgtccgctggaggctgcgggagggggcaggcaaggcggcgagtggtagcaggccgaccagggctttggtcatgcagtcgcagagccgctcgacgccgaaaggttcccgccgcaggtatgggcgtcggtgatcccgttggtggagagcagcagaacgtcaccgagttcggggacccgccgaagccgcggcacgccggttgacttgccagacagtgacccaccaacagtttcagaacgcttcttccgaggctcccggttcagtcaagtctcgagtggaggcctcgaggcgggcgtccggactgagcaagtcaccgcagccgggctgccgcccgcatgccgcagtagcgaggtgccactgcaggccggcgacgcgcagcatccagcagactgtctcactggctgccaccagccgcagccgctcgcctaacgccgtggcggcgcgatccagtgttcgcagtccggcgcagtcgagaaatgacacgttcgccaaatctagatcgacgtggccagtaccggtccatgcgtcggctagggcttcgccgagtatcccggcggttgccaggtcgatctcgccgacgacgcgcacgcgaactccgcgccggctggcgacggtttctacctgtagcgccgtgactaccatctgcatcacctcgggatcgacgctaactctcgtcaatcgctgacaggatcgtcaagacagccgtgtgcacctctacaaccggatgaacccgatagtgctcgccgccgaccgctacccgacccgatgccgtgagcagcatcaacactaagggcgtcatcagtattgccgcgacatgcaaggaggtgactcgaccgcagttttcgacctctttcactcacccccttcatatatgcaagttgcatatatgaagggggtgtcaaatatcgcccccgaaacgcctctactaacacaagctccgctgccaccggaagggtcttgcaggaaatttgactttcgggttttccgcggttactgatcttcgaggaggggattagagcccccgttcgagcaacaccccctacggttgaacggagatccactgatgcgtatccgtaccgctgtcgccgccctcgccatgaccgccggcgccgccgcgggcagcctcgcgctgaccggcccggccatggcgaccccgcagaacggcctggtcaacgtctacgcccaggacatcgccagcggcaaccaggtcatcctgttgcagaacgtgccggtcgatgtcgccgcgaacgtgtgcgggctgaccgtcaacgtgctcagcaccgaactgctgtcgggcaaccacgccgtctgcaccgccaagaacaccccgaccaccaagtcgtgggtgtcctacagctgaaccagcaagcccggtgacgcccctcgacaccccctacgccgaggaccgaaacaaccgggcaccgtaatacctgcggccagatcaaccgagtaatcagcaacaggcagcctcacgccccctacggcgtgaggctgcccgcacatccaccctccaccacctggcccactctcgctgaacaccaccggtggatagtccaagatcttccaacccgactctcggcgtgaaccggcagacgccggactgcgccgctggccggtcgatccggccggtccctggcaccggatcctgtcgacctgcctgctcggcaccgcgcaccgattggacaggccgacgctccgctccaaaccgaagaagcaaccaactcgcggaacccctcgcatcagcacgattcgctttatggaaggcaccttctgccgatacgggcagcaagggcaatgcccggggccacatgcgatcacccgaaccggggttgccgggctttcgcaggtggccgacagtggaagctgccgcagcattccccggccagaaaggcaaaccgtcatcgagaccagccagtggtgccacgtcgctcaggacgccggcacctggacggtgaccctgtttggggaactcgacctgctacaggccggtgagctgtccgcgacaccgaccgaggcagccggtcatgacgacacaatccgggtgtgcgtcgatctagccgcggtgaagttcctcgactccaccgtgatcggcgccttgctgcaggtctagcaccagcacatgatcggcgtaggcgagcacgcctgccacgtcaccttgcagttgcaccgtgcccgcgaccagatcgctgtagccgccggttcaggtctttcagctgaagtcggtggtcagcgtgttcaggacacccgccacggtcaggacgcgccggacgtggcctgcggcgtgagtgacggtgaactggcggttgctggaggtcgcggtgttacgggcgacgatcagggtgctgatcaccgtggagtcgatgaaggtcaccgcggtcaggtcgacgcgcacggtggtgatgccactgagggagagttgttcggcgaacaggtcgctcagggtggcggtcgcggcgaggtcgagttctcctcgcagggcgatggtgctggtggcggcgtcgcggtgcacgctgtgctgccaggtggggttcatgccggtgtgctcctgccggggttgccatgaagcggtggaccgggcttgatggccagctccgactgctgtggtgcgggcacagtaccggagcctgcggccggtgccgcaccggccgggataccaggggcagtcaggcagatagtgatggtgacggtcacaccgtcgcgccggtcggtaatcagcagggtgtcgctgagctgggtggccagccacagcccgcggccgccgggtacgccggccggtggcgggctgccggtggcggggatgccgtcggggaatccgctgccatggtcgctgatttcgcacgtcacggtgtcgtcgtgccggcgtagcagcagccggccccggccgccgccgtgccgtacggcgttggtggtcagctcctgtacggcgacgatgaagtcgtccagtcgttccccgtgcagcccggcgtcggctgtcgcggttcgaaccgcgtggcgcaggtcggtcagcaccgccgcggtgaagcgggagtccagggtcggcgccggtccgtcgaccggcctggcgagggcgggtgccggcgtgcgcatgacggcacggtgcccgggcggcgataccgcgaaacgcccacctccttacttttcatcgtccgcgcccacggctgctggtcgtggtcgcgaagcatcgttcacctgcatcggctgagcgcccgaccgcccctagtcatcggcgcacgatggggctcggcttgcgtcagagtgtcgttcccgctccggggctcgggcgttggggttcgcatcggtcggtgggcagtcgcacggtgacgctggtggccgcgccggtgtcggggttcagctggatggtgccgtggtggcgttcgatgatggcgcggctgaggactaggccgagtccggcgccggggatgcggcgttcccgggtgcggctggagcggtagaagcgggagaacaggcggtgccgctcctcggcggggatgccgatgccggtgtcggtgaccgtgacttcagcgaccgtgggcgcgggctgggtcaccgtgacgctcacctggtcgccggtctggctatgcgcgatggcgttggcgatcaggtgtccgatcacctgttgcaggcgtccgtggtcgccgatgacgaccggttcggcggccagctgaaggcccatctccacaccggcgctctcggccgccggggccgccgtggcggcggccgagcgtacggcagccgccaggtcgaccggttcgcaggcgatgatggtgtgtccgctgtcgaggccggtcaggtcaagtagttcgtcgacgatgtgcagcacggtccggctgttacgggcgatgatctccaacagctcgggggcgtcggcgagcagcacggcgggctcggccgtgagcaggaagtcggcgcagccggagatcgaggtcagcggggtgcgcagttcgtgaccgaccaggacgaggtactcgtctttggtgcgggccagggccagggcgagttcttcggcgcggcggcgttccaggaattcgccgacgtgtgcggcggtcccggacagcagcgcgatcagtgagtcggctgggtcctccacgacgtcggcgaagaatgacagcaccgccaggacccggccgccggagggcacggggatggccaggccggtccgcaggtgcagccccggggcggcgctgttgccgggtgcggcgtcgatgtcgcctatccagatcggtttgccggtgcgccaggcggcgcccgtgagcatgtcccccggttgcggctggggcgacaattcgccggcctcgacgtggtcggcggcatagtgagcgctcggcatcagcgcctgggcctgctcgtcgacaagccacagttcggcgtagggccagtgcagcgtgctgcagatcgcctccagcacgcgggagccggcctgctgcacgctgctggcgtgcgcgagtgcctcggccaccgcgaactcgacgtcacgaaaccgtgccgcccggcgctggtcggtgacgtcctgagcgaccacgaccgcgccgagccgttcgccgtccgcgccggtgatcggctgtgcgtcggtgcgcagcaccgtccgccgctgccccgggttgcggaccgtgatctcgacgtcgcgcagctgctcacccgccagcgcccgcagcagcgggacggcatgcgccggcaatgggcggccctcggcgtcagccagatgctgccgggcagcccattgcttcagatctgctggtggcgacgactcgccggcccattgcacggccaggtcgttggccagcaccagccggccctgggcatcacaggcagtgacaccggcctgcaggctggccagcaaggcgtccaggaagcgccgctgctggtccgcttgttggcgggcctgctgttcggcgacgaacgccgtacacgcctgtgcgccctcgcgtaccccggccagttcctcgtcggtccactgccggacctgatagtccagcacggcgcacaccccgaccagcgtgccctgcgggtcacggatcgggaacccggcatacgcgcgaccggcgacggcgctgatcggcgcaccggccggcacccggacatccgcggcggtgtcggttacgatcagcggctcgccgctgccgagaatgatcccggccagccccgaggacaccggaacatgaccgatacgcttccacccgtccggcagtccggcaccaccggccagccgcagatgatcaccatcggtgagatggatcagcgcggtcggcgcgccggccgcccgcgccgtcaccgccgcgagcttgttcgccgcttcccacgacatcgccccggcagtcagctccatctgctgcaccgacgcgccggcatcaccgtcaccctcggcaggatgttcctcgcccatcaccgcagccaaacatgacacaagggcacatatccccggaataggtcagcgttcatccgagggagcggtgactgcggcgcctccagcacccggtgactcgcctatcgcccgcgagtgagcaggcccgtagcgggaatcgcagcggccatgcgagatcaccgcgaggaaactactggctacgatgccacagaccgatgcgctcgaacagcagcaggaagtgcctgagccggataccgcagcgccccgggacaccggcctggaagccgagcctgccgacgtggccgaacagcgtgccgccgccctccccgccaagcggatccgccggcagtcgcccttcggcggacgccgaccccgccgatgtggtcgagcaggcccggaccgtaccgccggccgacgacgatcgctgatgatccccgcggcctgcgcagtcaccggcgccgagggctacccgggacgccagcggcctcagccacgccgagaccgccggcatcctcggcggcgatgacggcgtcgcgcgagtggatcagcgcctcgctgcatgtctcgcagtttgacgagctgccggggcgaccgtggtggttatgagcagaccagcgtgatcttctcagcggtcggcgcgccggtcacactgtcgccgcggtcgttttcgttgtcgtcgctgtcctcgttgtcgttgtcgttgtcgtcggtctttagtttgtgcactgcttggccgggagtgaggtcgtcgatggtggcggggtccgggcaggccgcggaccggcgataccagccgatctcggtgtggtcggtgacggtgaccgtgacggtcatacccgccgcggtggacagggtgagcgccgcggtggtggagtcgtagccggcgatggtgccagcgttgtcctcgccgtcccggacgccgtcgtggtcactgtcgccgtcgcgggggttgtcaccgctgtccagttcgtcgccgtcgctgacaccgtcgtcgtcgctgtcctcgtcaccatcggacacaccgtcgccgtcgctgtcggccttctgcgggtcgtcaccgagttggaactcgtcaacgttgctcagcccatcaccgtccgcgtcctcagcgccgtcggcaactccatcgccgtcactgtcggccttgagtgggttatcaccgagctcgaagtcctgcacgttgctcaggccgtcgttgtcgggatcctcggtgccgtcatcagtgccgtcgcggtcggtgtcgcccgcgcgggggttgtcgtggacgaggtattcctggtggttggtcagcttgtcggcgtccgcgtcgtcgctggcgtcgttgcgcagcgggtcgagacggttgccgacctcccacccgtccggcatgccgtcacggtcggtgtcggcggcgcgggcgctggtgcgcgccttgaactcggccaagttcctcaggccgtcatggtcggcgtcgccgctggcgtcgttgcggcgcgggttcaacccgttggccttctcccaggtgtcgggcatgccgtcgtggtcactgtcacgcaccgctggcacggccggtttcggcttgtggcccttggccgccatggcggcgccggacatcgacagggtggtcaaggtggcggcggccgcggcagcggcgacccgcaagttccggcggtggttcatgcaaggggtccgttcttctcgcgactgcggcggggaaaccgcaggctgcgctactaaacgcgatcaccataagaccatcggtgaccagctagatgatcttgggcttgggtgctaccgaaccgctcccgccctgcaccgacgcgccgccagccggagggcaagagcgccggcctgcgcctgggttccagtcgcggcgggcgttgaggaccatttgcacggcgctggccaacagcgttggtacggtgctgacctggatcagggtgccaccggtctcgacgagttgggtctcgggcaggccccgtagtgacccgtacaccagaacagggatgccggccgtcgcagcgtgctcgtgcatgactgtcaggacgtgcgtcatctctggctcaggcaggtaggcgtccaggacgaccacgtcgggcagaccgtcgacgatttcggtagcggccggtgtggcgcggctgaacagcatcggaatgtggccctcggcggtcagtagttcctggattctgtcgcgggtgtgccggtcggtgatcgcggccacgatgaacgccatggcggcagtgttactccttcatcggcttagcccgggggcggtagggcatcaccatggcaaccacggctgtggtcaggctgaagatcccctgaaggcggcccggggcgaccgcgacagctaggatgcgtcggcccgcacggtcccggtcggccacgctccctgagcagagcatgtgctggccggtgtggcgggtacccaggaaacaaaacgcgaccgtgcccatgggtcgcggcgcacgccacaggccacggggcaggaaggacccgcatgaatgcttcggagtcgctgcggcagctgctgcgccagtcacaccatgcccggcccgatgatttgccccagatggcgatgcgtgcggcgccgctgctcaacgccaccgcgatcatcctgtacctggtggatcaccagcagcggctgctgatcccgctgctgggcggcaccgccccgcagcgggacccgttcgccgtcgacggcaccctggccggccgagccttcactctaatcgcgccctgcgtcagcgacaccgaacccggcggcgtgcggctgtggctgccactggtcgacggcgccgaacgtctcggcgtcgtcgagttcatcctcggcagcccgccgggcgacgacaccctcgacggctgcgccgcggtggcgtccctgctggccggactggtggtcacccgcagcctctacagcgacgccatcgaacaggtacgccgccgcgaacccatgcagctggccgcggagatgctacgcgcccaactgcctccgctcaccttctccaccggccacctggtcatcagcggcgtcctggaaccggcgtacgacgtcggcggtgacgcgttcgactacgccgtcaacgccgacaccgcccacctggccctgttcgacgccgtcgggcacggctccgccggcggcctgcgcccagtcatgctcgcctccctggccctggccgcgtaccgcaacgcccgccgcgccggcctcgacctcaccgccacctatcaccacatcgacaccgccgtgcacggctacgaccgcggcgggttcatcaccgccgtgctcgccgaattcgaccagcgcaccggcaccctgaaagtcatctccgccggacaccccagcggcatcgtcatccgcgacggcaaagtcgtcaaaatcctgcccacccccaccgcgctgcccgtagtcatgggccgccaccggccgcccctggtcgtcgaagaagttctggaacccggcgaccggctactgctctacaccgacggcatcatcgaagcccgcgccctggacggcgccgagttcggcctcgaccggctcatcgacttcgccgtcaaagccgccgccgatcagctatccctgcccgaaaccgctcggcgcctggtccacgccatccacgagcaccaagacgaccagctccaagacgacgccacagtcctgctcgccgaatggcgcaccccggcaccaccggcctccgacactgaactactcaccgcaccacccggcgccccgctcgacctacccacctagagaccgaatcgtgcacacccccagaggcaccgatctactgggtctgtccgcagacagcgcgtccgcatgttccaggccgccaagaacgacacgatggcaagcttcgtggccaggcatcccacaggggtcgcgcagaactgaccgaatcgcaaggaaaccgtgccgtcaccgcaggccgccgcagccgcaggcgcgggaagacgcgtctgcggcattggtgaccgtaccgtgagtccgggcatgccacagcggtgctcagcggccgacagggcccgcccggaccatgccagcaagcaggagaagggttcgacatgttacggctgctgctgttcgtcctgccgttgggcctggattccttcgcggtcgcggccgcgctcggcgcgctgagcccctcacgccgcgaacgctggcgcatcaccggcctgttcgtcgccttcgaggccggcatgccgctgctcggcgttgcgatcggagcacccatcgcgcacgctgtcgccgggatcgcggactacctcgccgccgccgcactggccggagtaggcgcatggatgttgctgggcggcgacgaagacgccgaagaggaacgcgtccgccagctcagcaaagcccacggcatggccatcctcggcctgggcatcgccatcagcctcgacgaactcgccatcggcttcagcctcggacccggctatccatcaccgaagtcctgatcgccatcgcaatccaggccttcatcgccgtacaactgggcctacgcctcggcgcgcgcgtcggtagaagggacgaatgttctcgctgggccgttggacttcaacgtccggtcgaagcggacgccctcgtcccgggcccgctggcggtgtcgtaaggctgccgcggcgccgatggcgggccgccttgcgcgcgagaattacgaccgtgccaccgacgaatcccgacacggcaagaacgttgaggttccggcccaccttcttggggtgcactgccccgtccatgccgccccggttcatgccgccaggataagacgaggctggccgtgcgaccgagcgatcgggtgctaaccgctgcgacctccctcggtgacgggcgttgcagatcgactcagattcgctttggtggaggcggctcggggacgggctctcagtgtctaacgactaccagcgcggcgatgagcagtgccgaaacgacggcggtgagcgccatccccagctgccatgaacgcgcggtgttgtcgaccgatcagggaggcgtggcgtcggtagcttgccggctgccgtcccgaaatttccagtggcggatcttggagaccagcaggtacgaggacatggcggcgtcggcaggtgcgaaggccggattcagtatcctccggcgaggtcggtccgagccggtcggtgaggggcagcaagtcccatacccggcggactgccggttgtgggaacaccaggcgcagggtgatgcctgcgtcgccgggcctcgccgtgggcatggtcgagactgccatacctgacgagtcgcagaagctgatctgcgcgaagtcgaccatgatcatgaggaccttaagggtgccggcgatcgcgtcgtggacggctaccaagggctggtcaagctcttgcccgtagcccacatccgctcagcgccgaagtgtgccaaccgacgacaccgagggtgtcctccaacaacgagatacacaaacacggatacttgactgacccctgccaatagccgtgaccgtggccgaccgtaagcggcggcggtatccgcagccacatcgcgattgaccggcgccgtggcgatccggactccaccggcacgatccggaggctatccacggggaggggcagcatggttctaaaagaaggcaggggcgcacccttgcgccatcgacgacaaggcgcagcgctcagtttcgcatgggcgcgcggccggggttcgatgcaggggttagcgctggtcgggctggcggtgtgcgccatggcggtagtcctgggtgcggccgtgccagctgcggccggcacggccgcgccattgctagatgatcggtgccgtaccgatctgaccgatgtctcatcggcgcacgcgcgggtgtggttctcgtcggccgccggaacaccggaacgcgacctggcgatgggtgtcgcacaggcgatggagcaggcttacggaaagctcgtcgcggatcccgcattgagtttcctggctccgctgtcggatctacgccccgcccgggccaaatgcgccgatggtgtgacctaccctgatcgcggcgacggtcggctcgacgtgtttgtggtgcccttcggtgacgccgggcatcccgacggtgatccgaagctcgttcgcgcagcgcaaacaaacccctaccctgcggattcgggtgtcgcgggctgcgccagctggatcgaaatcaacgatgcaattggtgccgctgggatggggtacaacgcggtgcacgaattcatgcatgcggtagagaactcgtaccggtgcggcggggacatcccggacaacgacgcctggtggtacgaggcgagcgcgacgtgggcggaacagtacgtcatcccgaccggcgaccatccgctgtccatggcgaaatcctttttcatgccgacaccgtcacaaggcatgcccgaggaacccagcacgcgctggtacggcgaattcctgttcccttggtatatccagcacgtcgtggacaaggacaagccggctccgcagacactgcgccggatctgggagctgttcggtacgacgccgtctacctcggccaccgaggccgtggacgtcgcggtcggcgggttggaccaccgctggcccgagttcgcccggtaccactggaacggggactacaacgccgcggtgccttcggacaattcctacgccgcctgggacgggcggttcttgggagtccagccggccgtcaccgaccaccggctcgagcttggcggcgcaccggacgtgctgtacccgctgcagatcgccacacccggaaccgccgggagcacaccgctacggctgccgcccctgtcctccgcctacttccacgtgtccgtcgacgacgaccacatccgctctctggtattccacaacgggtggacgtaccggctgagccagatcaacacccacagcgaggatcccgtggtgggcatggacgggcagagcctcgtcgaacaggacctgccgggcgccgccccggccggtctgcacgtgcaggcgctcgtcaaaatccaaggctactggcatgacgaggacctgaccgaacagccctggcgggcctggtgccgcgacgtatacgagcagcacgtcgaggacctcgtggtgatcgtcaccaacgcccgcattgatgccacggcgcaggtctcgccggccgagaaggatccgacgatccaggcgtcgaacatcggctgcgcaaaggtcgaccctggcggcggcgtgcgcaacagctacgccgattccgacagcgacctcgccgtgtcgacctcactgaccttcggtgccccggtacccaccggactgtccggacagaccagctcacaccttgccggacagcacgccttccaggggtggacgttcccggtcaccggcgggaccagcaccatcaacgaacagatccacgaagtagacggagaccactgcgcagggcacggaaacgccaccagcgcgctgcccaacctctcacccccattcgagatcggcctgcacctgttcgtcaacgtgctaccgggcggactcgagtaccggcactaccgattcggcggattgcccgcggtcacgcaccacaagttctccttccccatcgcctgcgacgagtacagcgacacgacgaccgagaagggctggcggtgggcacccgccaccatcgcggacggcgatccgccggcttacgttccctacctcatcgccgccgacgggctgagcgtcaccgccgaccatctcgacgtgcccgacggcggcggcaccgacggcgaatactcctacacctaccgcttccatctgaactgaccacccgcagtgccgggtaggctcgcccgcccggcaccgcacaagccggtctgcaccaaggggcaccgggtcgcccggtgaccgggcgacccggcccactaacacacaggcgagctcatggcggccggcccgaacctgtctacgtccggccaccactggccaatcacgcctgcgacgccgcttctagccgcagccggaaccgagcatgtgtccgcagcaatcccgccgtcaccgccaccgcctggtgagccagctcccggaagaccgtccaatacgtgtccgccgtggtcaccgcgctggaatggccgagatcatgctgaatcaccttcaactcgacaccagccgcacccgccagactcgccgcaccatgccgcagatcatgcaaccggaccagtggcagcccgaacctgacgaccagcacgtgaaagcggtgagtgagccagtccgggcgcactggacgaccatccgctcctacaggctgagctgcagtgggcgttgttcgctcgtcttcaggacaacatccgttgccgttggacgccggcggcagtgcaaaccctggtaaacggctgccggacgctcgacacgctgaccgacgtcgacgtggccagcctgcccagccggtcgcagagcatcgcccaggcgatgctgcagtccctacgggtggtctacgtgacgccagcgcagacccgagaagccggctacctcgaactggatcacttcggcaccagcattcgcggcttctccagccactacgacctgaccggggtgacccagcgatggctgcgcgatcttctgtgggactacgtcgccgaccagctgcgcaccccgggcagtccgcgcaccaagggcccttacgacgacacgcggcgtgcctgcctcgaactgagcgcctatctcgaggtcgccgccgagagcggcgggcacgacccgacacgcctgcatgccgatcatttccaccggttcctggccgatcagcgtcatcgagcccgccaccaactgccctcgctggtcgtgcgactgaagacgggcaaagccagcaccgtcaccgagacgacactgcacttcatcttcagccacgctcgcaaaatcatgcggtgggcactggaacgcggggagaccgaccgcatcggcctaaaccgcgacttcgtcgtcgccttcccgtcaatgggcaccggcacccatcggacccgcagcccgttcactgacgacgtcgcccaagctctggcagctgaggacaacctccggcgcttcgccgatgtgcacgatcccgcagaccgaggcctacgcgatatttgggagatcatcatcgtgaccggccgccgggccagcgaagtgatcaagctgagcctggactgcgtcggccgctacagcaagctgcccatgctatggcacgaccagaccaaggtcggcaactacgaccaggccatccgcatcccggagtacacctaccagcgcatccttgaacggcaacgccagactttggcccgtttcgagggccgattcggtcatcccgcgaccccaccggagcgggctcggatggctctgttccccgccccgaaacacaaccccggcttcgcgcgttcgctcagctacggctggtacggagccgccttcaaggcctgggtatccgaactcgagctgggctcctgtgtcacccaccaggctcggcacactctggcgaccaagttactggccaacggggccggcctgcaccacatcaaacggttcctcggacacgtctcgaaccggatgaccgagcactacgcgaaagtcgccgtctcggagatcgaggacgtgctgcagcacgtcggggtctccggccccggagctgcccgacccggcgagatgctgtccaccggcaccaccccactcgaccggcacgaggcccaagccctcgctctggatctcacccgccgcagcatgctggccgagggcggcttctgcaccttccagcccgtggtcgacggcggcgcctgcccctggaatctgaactgccatacctgcgacaagttcgtgctctccggtgccgacctgctctactggcgccgcaaacgcgagcagtggatgtccatcgcggaacgcgccccggacgatgccaccgcggactacctgcaccaagtcttcgagcccaccgcccgcgctatcgacggcctggagaaggccctcgctgggctcggcctgctgcaggacgctctcgcactcgatctgcgcaggccgcaggactacttccaccgcatgtggtcgaccgccttccgcgccacagacctggctgacgcggtagccaccgaagcgatgacatacgacgacggcatcgccgacgagcgggaggaaccctgcgcatgaacaacgccgccgttcccgatctccgcacggctgcggccttagcagcccggcgccgcagcaccgaggccaacatcgcacgggtgcacgacgccctcgcccgcctccgccgcgaagggctgccgatcagcgtcgccgccgtcgcccgccgggcaaccgtttcccgcaccttcctctacgccaacccacaggccaaagtcgcagtctccgacgccatggccgaagccggcgaacggcgcagccaggtcctcgacgaccaggccgtcggacgtgaggcgacctggcgcgaacgggcgctcaacgccgaagacgctctcaaagccgcgcgcaccgaaatcctcacccagcgggcccggatcggcgagctcctcggccagattcgcagcatggaaaccgaatgggccgaagagagcatccagcggatcaccaccgagaacaccaccctcaagcagcagctccgccagctcaccgccgacacccggattctcgacgaacggctcaaagccgctcgatccaacatccgctttcaagaccggcgtatcgccgacctggaagcccgcctcgccgacccggcaccatccacgtgatgccgctccgcgggatgtccgttccagaggcgatcgcgaaaggggcggatcgcccactgcgtcaccaggtcgtcagtcgtcgttgcgccgaggcactcgacgaagagccctgttgccaacctggcgatatccaggacgtccggcgaacacaggtgcgtgggggtcacaggcgttgtcgatcaggctcagccagagtggatcggtcagcaaacggggacgccggggacctcgttgtcaccggtgaaagtgatcggccgatcgaggggaagatcacgggtagtggcgatgcccagccagctaatcctgaaccggagggaatcaatggttatgaagctgccttccgccatggtcggctggcacgtcatggtcagcgaccactggacggtcgcctcctcttcgggggccagcgtcacctgcttcagtgcggtcgccgacttatcgaatccggggacgcccgccacgaaggtgacctgctgatgtgagagccattcgaccgtgtcgacgcgtcgaggccgtgcacggtgaagggcaggtgaccgtcgttgcggacgctgaaggtggcggttaccgtcgcggcgtgcctgccacgcaccaccattcgggtctccgtcacgccgtcgttggcccacgacatgccctccccaggactgatcacgctgccctcgcccatccgagggttgccccaccacacgaaggaggtggcgcccactgcggcaacaagcacgacggcggcgatcaccaaccggcggcggcgctttggccgcggacgtggatcagtcaccgtagtcgtgctgccttccgtcgtatccatcctgatcttcctgtgccggtgggccccaccgtggaagatcgtgccacacagtgccccagccggttcggtgatcaccgatcgtctgtcggccagggcgggcgcaatcggactcgcggtggacattggccgacggctactggccggaccaggcaccgaggttcctgtggcggcgacgccgcttccgccgcaggccccggttgctgggcccgaggatcgggagagtccgtgttgttgagtgagaggttgatggactctggcgcactcttggtggactcatcacggatggtgacgatctgccgagagccgagcgcgcgttgtctgcggcaaatccgtgcacctgcctctggaagtgaatcgtcagccaacacccgtgacccaatgagatcgctactccgcgctcagagccagacggacggtgggcgtgcggcggagctacgcgcaaggacagcgccagcggatccaccacgacgccatgctgattaacgtacgccatcctctgctgcacgactcgatgccaaccactacgaaggatgaaaatcgcattcggtgggccacgcgacccgggccggccggggcgccgagatggtcgaacccgctccgtgcgccacaccggactgtccgaggtcggcgcggcgactaaggccgccctccgcgaggccgtgaccaggcaccggccgagctgtgcgcgctaatactcgacggaccttccaaccggcgccgagccggaacccataggccgtccggcttttaaatgcctcaatcggggaattgacgtcgcctaggcggcccgggaaactggctggacgactgcggcagtcggccgtaaccccgtgtttacctttcgagtgctgaaccttcctcagtgtccggcagcacactggccggcggtgcgagtaacggatgggggtgctcgatgacggtcgttctccatgtgcacggcaccggagtgcgcgagcccgattactccacgggcttcgacagcttccgcgtgaaactgcaggcaatccgcccagagctgcgcgtggaaccctgctactggggcggcgagcacggcgcccggctgcgggccgagggtgtctcgattccggccgggcgtagcgcgcgcgagccccaggagccggccgatcgcgacgtggcactctggagcctcctcgcggccgacccgctattcgagctgtccaccctggccgcggccgaggcggcggcggcccgcggcggggccggcaatttcgacccaatggcggtgcgcggcgcggctaagctgatcgagcaggcgcccggcctggcggccgagctccaggccggcattgccgagctgggcctagccgacgtgttccccggggccgtccgggcggtgctggccagcgaggagatcagctcgctggcgcactccgaggtgcggccggccgacctgcgccggccgttcgcccgggcggtcgtcgctcagtcgctgctgctggccgcggaggcggcccgcccgccgatcgacggcacccaccgggatgcgctggtcgccgagatcgtggccgccctcgggggcaccgaccgcgggctcggcgccgacgccggcaagctggggctgcggctggccctgcggatgggcgccggcaaaccggtcgagcgccggcgcgccgcgatcacccggtcgaccagcgcggtcgccggcgatgtgctgctctacctggcccgcggcgcggcgatccgcgaccacctgcgatcccgcatcgaagagctgggcgacgacgtggtcgtggtggcgcacagcctgggcggggtggccgccgtcgacctgctcgcgacgaccccgctgcccgcggtgaccggtctggtcacggtcggctcccaggccccgctgctgtacgagctgggcgcgctgcccgggctggagttcggcaccccgctgccggtcggcttcccccgctggctgaacatcttcgaccggcgggacctgctcggcttcaccagcggcgggctcttccccgggcgggtcaccgacgccgaggtggacaaccgctggccgttcccctatgcgcacaccacctatttcggcaacgacgccctctacgaagagctggactcgttcctccgatgatcgatccgctccgcacccgggcggtcgtcgtcggcatcgagcggtacgacctgggcgagagctggaatctcgacgggccggccctggacgcgtgccgcttcgtggagtggctcctcgccgagcgcgttccagccgggaacatccgcctgcacgtaagcccgctggccgacaatgcggccgaggtcgagagccacgtcgccggccggctcgacgtgcggccggccgagttcggcccgatccgtaacagcctgctcgacgtcggggaggagtcgagtgacctgctgatcctgttctggggcggacacggggtgcggccaccgacagagttcacccatctgctctgcgccgacgcccgggaccgggaccgcagcaatcaccgcctcgacctgctgctgcacatcatgcgcaccaccgcgttcgcgcagcacccgcggcaactggtcatcgtggacgcctgtcaggccgacgtcccccggcactggcagctgccggtgcaccaataccaggatgccgacctggtccgcgccttccggcagcaggacacgttgctcgcggccagcccgggccagtcggccggcaatgacgaccggaaccggaccggccgcttctccgacgccgtcctggccgagctcagctggcccgacgaggggcggttcgacgagctttaccagcgggtgaaggcacgcgtcgcatcggccgagcagcagccggtccggctcgccttcctgcaggacggcgtggaacaggacgtctgggtgccccggccggccagcccgaaggtcgtgccgctgaccgatctcaccgcctaccgggcgtcagccgccgcgtcgcccggcgacggccggccgccggtcgacgagcgctaccgggtgcggctcgacgtggcctgctgcctcgaccgggcgcccggtctcgcagtcctggccgggccggtcgagccggattacgccgcgcaactggcggccgcgctgaccgcggccgaggaccatctggccgccgccggcgcggtcgagccggaagcggttcgccgctggctggtgctgaccccgtcgaccggtcggccgccggccaccgccgaggagatcggcgccgaaccgggatggttgcgagcgccggtgcagggcgcggtggtcaccggcctgaccgacgtgcgcgtcgccggcgaatacctgcgcgcgatccggagactcgtccctgggctggccgtgctcgcggtggccggcccggagcgggcggcccgcctggctcgcacgctggaactgcccgagctgctggtcgcggcgttcgcaccggtcgagacggccggtcgtccggtgccgttccccttcccggccgggggcgcgctggtcgcgctggtcgcgcacctgcgggcgtacggcgcccagctgcccgccgtggccggcgagccgccggcgatccccgatgaggtggaccccgtcgcctgggcggcccaggtggtcgctgagctgaacgaccccgggcaccccggctacgacgaggccgcgctgctgacctcggcccgcgaccgccggcccggcctgtatccggcgctgctcgcgcagtacgccgagcggcgggccgccccgggccggctgacctcgctgaccgtggcggccgggaccgacgccgagctcagctactggctcacgcacgcgaccgagccgcccgacccggcccgcgagatgcccgctcccgaggtcgtcgacgcgctggccgtcgtgctgcggcgccgctcgctcgaggcggccgccccgtgggcgccgtacgccggccggcgggtgtccgatttggtgacgctgcccgccgcggcggcgcccgggctgttcgccaccgcctcggccgaggtggcgctgctcgccatccggtgcgggctcggcgagggcgtcgagcccgccgccgtcgaacacggtccggtgcgtcccggcgcgtgggcgctgctggtccagcagggcatcaccgccgacaccgcgaagtggctgtccggcctggacgaccacctgcgccgactggtcgggctgcggcccgaggacctgtcggtcgccgatcgggaggcgctggccgcgatccggtcggcgctgcacccgatgctcccgctcccgcacgccgcctaggaggacaacgtgctcgctgactggtatctctgcgccacgcagggactctcgctgtcgggaacggacgcctacctggacgcgctgcgcgcgctcgacgaaccggccgagcgggtcgagctggccgaggaggcgatcaaccagctgcgccgggtcgagcccggcctgatgctgtacgccctcccgcgggtgctcgccgcctaccgccggcacgccgaccggttgtcgctggccggccggaccgcggcctacctggccgagctggacgagttggccggcgggcaccccgagctgcgggccgcgttcgacgccctggccgattcgccgcgccggctgcgggcccgcatcgtcgcgctggccgaggtggtggcggccgacccggccgacgccgagacggccgagacggccgacgcgccggggccggcggccgtccccgatccgtacgatgacctgttcagcgctccgttggcgaccgcggcagtggctctggcggccgagttggcggcccggtcaccgcagaccgcccgggagtggctcggcgacggcgagccggagttgctgacggccgccttcgacggccggtacgggcggctcccgttcctgctcgcggtgcggttctcggcgctcattgacgggaccgccgagaaccggcagcggttgctggcgcggctgtgggcgttcggaaggggagccgccgacctggaaccggacctcgtgcaggaggccgccgggttgtcccgcgcgcaagcgtccgacgtgaccgaaaccctgaccgaggcggtcgccggcctggacctggccgcctggcgcaagaacgaacccgggctcgacccgcagcggcgggaaatcgcgcaggctcgttggggtggcagcggtgcgcccggcgccgcggccaccgccgccgtgctctggcaggtcgcgatgtggcgggtggccgccgagcgcgatccggccgcgaccctggcgggtttgcgcacctggtgggccgccccgaccctggtcgagcgctcgcggaagaccgccgacctgatcgtgccgttcaccgtgccgtacggcgagaagggctacgaggcggcctggaacaacctcagcaccctcgcccgggtgcgcagctgggatcagcggcggcagccgccgcggctccaactgaccgacggcccggtcagcgcgactccggcggcctcggctagcctggtcggcagcccgtggctgctgcgggcggtgcagcgctggcgggcgagcgccgaacgccgcgcctatccggactggaacgatccgccctcgttgatccggctcagcgcggccgccacgctcgccaccgacctgctggccgcggtgccgccgggcccggcggaggacgccgaccacctgctcgcgctcctgctgctgatccgcgacaccgcggtctgcagcccgctgcgggacgccatcgacccgcgcgccgccgtcggcagcccgctgccgggcgccctggtcgctctctaccaccacgcgctgatggtggccgaccgctgcggcaagggggatggcccgcacgcggtaccacgccggatcgtccggctgctgaccgcggggcgggccgcgcgggcgcgatgcgacgccgagccgacccagtgggcccggctcatgatcttcgccgcgccgatggccgcgttctggtggctgcgcgagacggtcagcggtggctggcccgaggagagcgaggacgaggacggctggctcaccgggacggcgcccaccccggccgcccggctgttgcggctgctgctcgccgagcgcctcgacctcgactccgggcaacgggccgcgcccgccctgctcgagcgcgacctgcggccggacagccggcacgcggcgggttgggactggcggccgcacgaggagcccgactgggactggctgcccaatgccgagacctacggcctcaccccgcccggcgctgacgcggccgagcagccccgcacccggcacgtcaacgccaacgtgctgttgctggcgccgcggcatggcctcgacgagtggcgctggtggtcgacccggctcgtgaaggcgctgggcgacgagccggccccgatggcgctgcagaccgtacggctggaggcgctgatgcacagcccggccgaggccgactgggccgacgactgggccgacgactgggccaagagcgtcctgcgtcgggtcgagccgtgggaactggcgcggatcgtccgccggcggatgatcgacctgctgcgggcgccgatcgacggcgacgagtccgagaaactggtgggccgggtcggcgagatcgtgatcgacgcgatcctggacctcagccgcgccgcgcagtggtaccaccagttgctgctgcgtgagctgaccagggtcgccgctccgccgagcctggccacccagtggcgctaccgggcggtcggcactctctaccggctgggcaccgaggcggccgggcacggtgccatcagcccgtacgaggttatcgggcagcgggtctcggccggactcaccgcgaacaacgtccgcgagctgctcttccagcacggcggcgccccgatcgtcgggcaggcggccgcccttggcgaggccgtcgagcggctctggcgcgacctgcggaccggcccgccggtgcgccgggtggagacgccgttgagcgacctcgaccacgcccgcgccgacgatctcaccaccgtcgccgtgcagctcgaccggtaccacggcaagctggtcagctaccacgactcccgggacggggtcttcgacgcgttcacccagcgcgacagggtggccgcggtgacctccgccctgctggccggcgcggacggctacggcatcgtctgtgcggtcgaccagcccgcccgtacggtgtgggtgaacgccggcttgggccacccggcgcggcacaagctcgccaaccgggaccggatgccgggcctcggcgacctggtggtcgcccatttcgccggcaccccgggcgcgccggtggtggaccgggcactcgcgccgatcgaccgcccgctggacaccgccgaggtgcgcgaggccaccgtacggccgctggccggcgcgccctggctggccgtcgagatcggcgggatggacgtctatccggggctcggcgcgactgacgagcgggaccgcgcggcccgctggcggtgggaccccgacctggcccgccgctacggcgctcccggcgaaccggtcgagaccggcgcttgctgggacgagacgatcgagcgctgggtgcccctcgaccggggcggccgggagctcatcgccggcgaacgggccgctttcgcggacggcctacggctggtcctcgcggagcaggtgaccgaggacgagcagacgcggctgcgcttcgtgacccggcctgggcgcgcctatctgctgggcgccgacgacttcgcgcccgacgactgggcccgcctgctcggcctggtcggcgacggccggccggggctggccgtcaccgtccggccggccgacccggacgggctgctcgtgctgctcgacgaggtcgacgagcgcaaccgcgactggctgcggatcttcgacgagccggaggacagcgaggtcgccgtgcatacggcggtctggtcctcggccggttggcacctgagggtcgagccgccggccggcttcccggccgagatcgcggtgaccggcctcgacgggtcggcggagaacgcgctctgcgtagtccgcgagtggggcgagccgcaggcccgggcggcgacggtggccgcggagcggatggcggaccgcggcgtgccccggcccaccgaggcctccgaagtacgctggcacgccctggcccacctgcccaaggacagccgggtccggttgcagcggatcgtcgccggcaacctgcgcaaggcctcgctgctcggcatcacgcaggcgggcatgggcgtgttcgtggcgaccgagtcggtgtcgctggccgccgatccggcgacgatccaccggttcggccgggaccgcgaggtgatcgtcgagtccgaccgggccaacgagccggtgccgcagcgcgacccggtcgccgtgccggacgaccagttgctccggctcagcgcggcggccggcctggaggccgtgctggccggggcggacgccctcgacggcatggtcgtgcaacaggtcctcgacaccgagaagcgcatcatccagtacggcctgtggctgcgcaacggaaaccgggtcagccacgccgtggtgcccgagcccaccctgtcggccctcaaggccgaggtcggcgaccatatcgacttccgccgggccaccaccggctggatcggccacatacgccgccgccagatccgtggccgggccctctacaccggcgtggccaaggtcgggccgggctggctgccggtcggcgaggtcgagcgcgacggccggccgtacaccgtctatcaggcgcccgaggccccgcagctggccaccgggaaggcggccgaacgggtcaccgagcggcacacggtcagccggctcgacaaccggtcctggtcctacaacggtcaggcctacgtgcgggtgctggtcgagcggggcaaccgggcgtacgtcggggaggcccgggaattcccgaccggctcgctgatgcgggtccgcagcaccgacctgcgcctgacccagcacccgggcgacgacaacccgcggtacacggtccggcgcaccttcagcctggaggcggtgatcaagcagccgccgcgaccggccgcctcggccgagatcgagctcgaccgctgggagcgggcgctgcgcgacggtcaccagcacatggtcggcatccgcgacggtgaccggcttctgctgagcggctatcgggccccgctacccgacggcacgctggcccgctggctcccgctgcggccggacgagttgccactggtcgacgggcatgcgtacgacaacggctcggtccgggcgctgatcgaggacgtcgacgccgggcacgtggcgtcgttcgcccgcgcgaccccgctcgacgtcgccggcttcgcggccgcgctctcgctgccggtcgacgacacccggaccgatctgccggatcccctttactacgtgggcgccgagcccggccaccaccggttcgagtggggcttcggctggacggtcgacgtcccggtggaggcgctcacgatcgacggcgaaccggccggcagcgggcttttccacggcgaccgggtgcgggccgtccggctggtccacgacccggcgccgcccggtggaatcggtctgcggctggagggccgggacgtggcgaccgcgctgagcgggcggctgatgcaggagtcggcggccggcatgatccaccgcatccaggtcgaaatcgacctggtgcacggccgggtcgccgtgctcggcgtgcacacccagcggcagggtgcgtccggcgaccggatcgaggtggccgcgcatccgatccgggccgagctggcggacgcggaggcagtcgtggcccgcgagcgcaaggccggcagatccggcaaggtgacccggcagctccatgcccgcctggacacctcggaggcggcccggcagggtcgtcgcaaggtgttcacgctcatcgacccggcccggctggccgagggtgacctgctctacgcccgggccgaccggatcgtcgacaccggcaacgagctctgcctggagctgcgcccgctcggctcggccggccagaagtggactttcagcgtggcccgccggcagttctccccccaggtgggcctgctggcccggcagctgcgcagccctggaggcgcgaacgcctaccgcggccggcagttcatggtgcgcctggtgcggaaggcgccgaaccggcgggaccgctggcacggctcgatcgtcgacaccccggctcgcccggcggccaccctggccagctgggtgcggcagcagggcgcggcctgcttcgccgtcctgggccgggacgacgtgctcgaggtcggcccgggcgtgttctacgacgcggccggcgtgccgggcgctcgccgcctcgagcccggcaccctgctgcgcctgctcgccgtgggcgccgggaaaccgctccagctggaggtcgccatcccggccgatctgcgctacgtccggaacggtcgcccggcgctcgccctgccgaagaactcggtgctcggcccgggcgggctcggtcaggcccgtaacggcaacgcgttcacgctggccgacctgcccgcgatcgaggcccggccggaccggggcctgaacgtccggtccctgcttcaaaccgcccatcccaagatcgtgtacgcggtgagcccggcccccgacgatcacgcccggctgcgttcgatcgacccggggaccgtggtcggcagtctcgaattggacccggccggcccggcccggctgcacccggtcggcggcgcggagccgcatacgctgccctgggcgcagctgtcgttcgccgagggcagccgggccgagctggcccgccggctgcgcgacgggacctgggaataccacgacgcaaccaccggccactgggacgccgacggccgcgagtgccgccgccaggaactgggcccgggcaacgccgaacgctggccggtgttcttcgccgaccgcggtggcccgaccgtgcgctacccccgcaaccagctgctgcggctcggcctgccgaccgccgaattgctcgaccggccgatccgcggccgggaggaggagacctatgtggtcgccgacgcgaccaccctcgaaggcatcccggcgctttggctggagctgagcccgggccgggtcgccgagataccggtcgccctgttcgcctcccgccggcaatcgctggccgacctcgactggtcgcagatgcgcggcggcgacctagtcaccgtgcggcggcggcgcaacgagcagaccgggcacgtcaccctcgagctgcgcgactggacgccggggctgcgcggcgcctggcccgggtcgccggggatcgtgctgccggtggtcgcgaccgaccgcgcagcgggggcgctgcagctgggcgcgggcgggcacacccggtggtacccggccgagcccgagctgctcgaccgtcacccggtcggcagccgggtgcggctgacctcggcgaaccggctcggcgcgggcacggtccggaccgatgacaccgtcctgctaatgccccgggacggcggctgggggctggccggcttcggcgacgtcgaggtaacgctggccggggacggcccgaccccgtggccgggcgccgcctggttgcgtgacctgctggccggcccggccgccgcgtccgggctgctgacggccctcggcggcgccctgccggtgaccgtggacgagctgggccggtccggcgaacgtctgacggtgaccgtctcccgccgcaatcagccgtccggccggtggccacgccggcggatcgtgcggaccgaggtggtcacgtcgatccgcggttcgctggtcctgcgcgccggtcatgccctctatctgatcgcggccgacaaggcagtgcccgggctggacagtagcgcggtcgcggccgccgcgaccgcgctgcgcgaccggcgtgccgtgctgtggtggcatcacgaggaggatgagctgcggcccggcacgtcggccggcaccggccacgccgagcaggcggtcctgatcgaggcgccgatcgaggtcgacggccagttcctcgggctgatcggccggaacaccgagaccggtgcgctgggctggctgccgtcccggctcgcgtcctggatcggcgagcccgacccgcggctgcccggcctgctcgcggggccggcgccggtcccgatggtccgcgagcgacagcagttctcggtggtcgaccggccggccgcggcccgggagcaccgcctcaccgaggtcggcagcgtgctgtcggtggtcgtcgccgcgttgccggccgccggccagccgggctatctggtacgtaccgcctacaccggggtcctgctgaccctgaccgcggcgagcggcctggccctcggtcagcggctgcgagccgaggtcaccgcggtccgtggtggccgtttcccgcagatcgtggcggtgccggcgggcgatcgccgggccgagctcgacctgcctcggacgatcgccgagcgcctcgccgcgatccacgcgacggccgacgagccgctcgccgcggtccacgccggctcgccggccatcgactgggatcagccgttccgcgattaccgggcggcgaacctggcggccgagtgcccggtcgacccggccgcagccgtggtgtggtcggctgcccaccgggccgaccccggggtgctcgcccggtggctggccgccggcggccgggaggccctggccgggcgtgctgaccagcatctggccccgctgctggcggcctgccaggtggccgccgagctgggtgagtccgacgcccgggcggccgccctggcagtgctcatcgcgcaccagatcggccgccgggcgatccggtccctgcacgtcgagccgctggtcacccactggctggcgcagccggaacggcagaccgaacccggcctgtgggcgcagatcaagcggctcgagctggcccccgagatgccgcctgaccggttgaccgtcgtggtccagcgctgccaggccatcctggcccggccggtgctgcacggccgagaggatctgcgggcgccggtcgcgcacgcactgctgttcgctaccggctcaccggctcgggtcgagcggttcggcgaccgggcgaactggcagccggacgccccgctgctctccgaactggccgccctcggccgcggcctgaccccgcccgccggtcggccggtcgcccagccggcgctgctaccgccccagcggcaaattgtcaaccgggccgcccgggaggtgattgggcaggcccttccggtgattcttttgcctactctgagcgccccaccggcgcaatggcaaacgttgctcgacaccgacgggcggtaatggagattcattattcagtgagcactttcaactcggtagatcgggttctcgacatggtgcagggtgcggaagacctgcgtggtcgcgatcgtccgcgacgggctgcagcgcagtttggtcaggagcgtgcctgtcttcaaggtcacgacggtgcgctcgcctgagcgtggattcgggcgtgggcctggttcacgggtttctgccgggccgacagctccggccggcaacggtgccgcttgaacggtgtgcgcacggtaccgccgacgccttggtaggccttgtccgcgaagctaatcacctcggcgctgggagcaacctcgagagacggcgccctcccgatcgttccggcgtcccggatctgcgaggccgggtgcactgttctcaagcagatccggatgttggcggacccgcccaccgtcacgtcgcgtagccgacgaatctcaggtgccagctgccgaccgccctcgtcctgaggaccacccagacggactacagcggctgttcccttcgcgccgtcgcggacatgtaatttatgtatcgccgcaggtcagattcagttcaccggtcccggcggtcggtaaagagatccaaagcgttgtcccccaacttgaactggatgcggccgtgctcacgcaccaagtcccgggattgcgccaccagctcgtcataccgctgctgtgttacctgcccgatcgtcgtcggcatagcccaccaccaggggtcgcccgcagcgcggcgaagaggccgccgtcagtaactacggtcgataccagtcaggctgaaccgccggtcagcaaggtcgcagtcccccgcaggaggtcactcacccgaacgacccgatgtgagtgacctgctccgccacgccctcgtacggcaccgcggcgaacagaacaccgccgacagcggccgatccaggccagccacccactcggcgccgcactgcggacacgccacccgatggtcctgcttcgccgcggcgagccgggcccgactccgccgcaccgtgcgccaatgccgggcccggcacgccgtcgagcagaacagcatcgacatccgggtcgtcggcggcaaccgatcaccacagaccggacatcgccgcggcggctcctctgccgagtcccgaaccgcgctggacggttgcggaaccagcgacagccagccccgagcaccgcgcttcgcaccgctcatcccgcaagcgtagaaccggctttaacttgatcttgaagtagcgagacaggcactaactgggcgtttggttctgatctgtgagtcttggtgacgaaaacgggtcggtcagtcgtgctagccgcagctatccgcatgcccgaaaggtcgattaggcaacgattgctgcgtcttcggctgccgatttggtttctcgatcgtgtctggttcacctctgtggtggtatcgccacacttgacgtccgagacggcctgactggcccacgtatcccgagcctatgacccaccgccgtgcatacccgtccgacctgtccgacgcccgatgggcgctgatcgagccccgactcagcgcctggcgccagaagcgcaccgacgccggcgtcgggggccgcaccgccgaacacgatctacgagagatcttcaacgcgatcctctacgtcaaccgcaccggcatcgcgtggcgctacctgccgcacgatctcccgccgtggcagaccgtctactggtacttcaaaacctggaccgaggacggcatcttcaccgacctcaactacgacctgaacgggttggtgcgtaacaaatccggccgcagcaccacacccacggcatccatcatggacagccagagcgtgaagacgtccaccaacgtccccaccgccagccaaggcatcgacgccggcaagagaatcgtcggccgtaaacgcggcatcatcaccgacactctcggcctgctccttgccgtgatcgtcaccgccgcctccgtcagcgacaacacgatcggcatcgacctgcttgaccgggccacccgcatctatcccactcttacaaaggcctgggtcgatgccggcttccgcaccaaggtcgtcgaacatggcgccacgctcggcgtcgacgtcgagatagtcaccaaggacccgcaggtcaaaggcttctcagtgatcaaacggcgatgggtcgtcgaacgcaccatcggctggctcatgcaacaccggcgcctggcgcgtgactacgagactctcccagtcacctcggccacgatgatccgcatcgccatgatcgacaacctcaccaaggaagccgtcgacgaaaccaccccaacctggcgagacacctaaaacggcataagacgcaaactacgtgaatcagacgccctctaaccctgttctttaacctccggcttgcggcggggcagggtgccgagacttctatcgaacgagctcggcatcgaggagatcggcggcttcgtcgaggacggtcgcgaactcgtccgccgggatcctggtaacggagaccttgtcagggccccctgcggggtggtgctcggctcgccgatggctgaagacgatcacgaggtcgtcggcatctagatacgcgtagcttgtcacgttgtcgacgttctctccccagtgcatcagccagaactgctcacgaaagtcggtctcgtcgtctgcatagaggagctggaaaacttcttcgggtgaatgttccgggaacgggcacggactgacctgacggcgccgcaccttggctgccgtggatcggaggaagccgatgaaggtaggaagaaagacggtgttgtcctcggtggtcagccacttgccggcggcccaaagatcgacggtgcgcagctcgccggtggcccgggcgggtggcggtggccaggcctcgcccacctcgacagcgaatctggctcggtcaccgaatcgtcgcgtcataggaccgtcaaagtagcagctcacggggaccgtgatcttacctcgcccactgggtgggtggtgtcgctacgcgctcgtatgcggggccggcgctcgctgctggagccgcttgaggtacccacccgccccggccccggacgaccgcggggatcgaagaaccacagccgcgcggcccgctacgacgtgggcaagaccgtcaaacgcgaaacctcgctgggcggcccacctcgccgcaagcccaaagcccgaggttaaagaataggctaactgggcgtttggttgtgttctgtaagtcttggtggcgaaaacgggtgggtctgtcatgctcgccatagctatccgcatgcccgaaaggtctattacgcagcgattgatgcgtcttcggtcggccgatttggttcctcgatcgtgtctgattcacctctgtggtggtatcgccacacttgacgtccgagacggcccgactgtcccacgtatcccgggcctatgacccaccgtcgtgcatacccgtccgacctgtccgacgcccgacgggcgctgatcgagccccgactcagcgcctggcgccagaagcgcaccgacgccggcgtcgggggccgcaccgccgaacacgatctacgagaaatcttcaacgcgatcctctacgtcaaccgcaccggcatcgcgtggcgctacctgccgcacgatctcctatcagttacgtggaatcacacgtcgcaggagccatctcgtatcctgcggcgtcttcacgggctgaggaggcgtgttgggcagcgcggtggtgttggaggagaagtggccggtccttggccggcatgagcgggcggccgagtggctccgagtatggacggacctgggaagagcgccgcggacgatcgacgcctacgcgcggggcctggccgagtacctgctgatctgagagcgggacgacgtcgacccagtgacggctggccggctgcatgtggccgcgttcgtgaaggacctgtccacgcggccgagccgccgaggcgagaacgtggtcgcgctggactcaggcgcgggtctggcgaacgcgacgctgcagcagcgcctggtgccggtccgcttgttctacgactacttgatcgaagagggattacgcgagtcgaacccggtcggccgcggccgctacacgccgggccgaaaattcggcagccatgagcgcggcctggtgccgcgcctggtgaaactgccctggatacccagcgagcagcagtggctcgacctgctggacgtggttcgccaggagccggtacggaaccgggtgatgctcgccctggcctacgacgctgctctgcggcgcgaagagctttgttcgctgcggaccgacgacgtcgatcccgcccaccggacgcttcggatcagagcagagacgacgaagacccggcgcgaacgcgtggtcccgtactccgcgccgaccggcgtgctgctgtccggctacctcgcgcatcgagccacgatcagcagagcccgcggcccgctgttcctgtcggagtcacaccgcaaccacgggcagccgctgagcctgtggacctggtcgaaggtgatccgccgcgtcgccctggccgcggacctgccgcgtttctccacccacaccacccgtcacctctgcctgaccgacctggcccggatgggctgggaactgcacgccatcgcgacgttcgccggtcaccgccacaccgagtcgaccatgacctacatccacctgtccggacgggaccttgcggagaagctgaaccgcggcatgcagcagatccactcctggcgcatcgacatgcttacccgagtcggcaactcaggcgggatgaacagccggtgaccgcgacgaccaccaaggccgccgccggcagcgcgcgactgcctgccagctggccgtggccactcgacctggaccgctacgaccggcgagccctggtgaccggcgccgaggcgaaggcgctcgctgtcttggagatcgaacagctcagacgcctgggcctgacgccgcaggcggctccgaggcggctggtcgagccgctggcccatgcccgggactgcctccagtgggcgccgggcactggtcaccagcgacggttcgccagtgacgcggccggcctgatcttgatccgctgcggtgaactcggccgcagctactggggctggtcggacgaggactggaccgacctgatcgaccgttccgggggcgagttccggcgtcggtggagcggccagatcggctcgaacgcgcgcccattcgtgatcgcctacgcctatctcctcggcggcttcactgcgttcgagcagatcggacgcttccaacggcccacgctcgctcaccgggtcttcggccaagccctggtcgacggcgcggtcgggaaaatcctcgcggtcctcggtgactggggctatcagcgtcggcccgaacgcctcgtctccgccgtctgtcaagctcttctgctgaaccgcagccctcggctggaggatctgtccggccctgctctggccgcgatccgcgcgtcggtggccatgcaggagagcgagtgggccagcgacctgcacgggatccaccgcgccgttgccgctctcggacatgccgacccgccgccgcgcccccgacacggccccgggcccacagcgatcgagggcacctcaggagcctgggtggactgggtcgaacgctggcacgcgacctcgacgctgaccccgaaggtccgcagcagctatcgcagcgtgctcgccaagatcggacgctggctggccaccgaacaccccgacgtcaccgcgccggagcactggacccgccagacctgcgcgtcctgggtcacggccgttgaccgcatggcggtcggcgactactcccaatggactacgggcatgcgctcgcagggccgcataggcaagccgctgacgccgcaggcgaagtccggatacatacaggtgccccgcacattcttccgtgacctgcacgaatgggagtggatcccgcagcgcttcaaccctgcccacgcgctgaggacacccagaagcgttcaagccctcatgggtcccgacccgcgcgtgatcgccgacgacatctgggccaaactgttgtgggccgggctgaacgtcgagtccggcgacctaccgaccgccgatggccgcacctaccccgcagagctgatcaggggtatcaccctgacctggctcttcgccgggcaacgcagcgatgaaatcgcccggctccgcgtcggctgtattcgctggcagcacgacggcatgcccatccccggcgactccggcgaggtcctggcccgcgacgcggtctgcctgctcgacgtccccacccacaagaccggtaccgccttcaccaagccggtcgacccgctcctgggccaggcgatcgaggcctggcaggcagtccgacccgaccaacccgccatcctcgacccgaagaccaacgaacccgtcgacttcctattcgctttccgcgcccgccgggtctccaagcattacatcaacggcacgatcatcccgatgctctgccgcaaggccggcgtccccaccgccgacgtccgcggcaacatcaccagccatcgaggccgctcgaccatcgccagccagctctacaacgccaaggagcccatgaccctgttcgagctccaagaatggctcggccaccgaacgcccgaagccaccgcccactacgccaaaatcaccccgaacacactggccagggcctacaacgacgccggctacttcgcccgcaacgtccgcaccatcgaggtcctcgtcgaccgcgatgccgtcgccagcggcgcggcagcagccggcgagccctggcagtactacgacatgggacacggctactgcacctacacgttcttcgagcaatgccagcaccgcatggcctgcgcccgctgcgacttctacacaccgaaagcgtcatccaagggtcagctgctcgaggccaaagacaaccttcaacgcatgctggccagcatcccgctcaccgacgacgaacgcgccgccgtcgacgacggtcaggccgctctcgaccagctgctcgagcggctcgtcgacgtccccaccccggccggttccaccccgcgacagatcggagcgcctgccacggcaaccttgcttccgatcctcgccatcacgaagcgccctcacgatgagtaagcacaattgaagatgacgccatctgcccactcgctctctagctgtgatgtccggggacggctgccgcgctcagggcagaagcgttctgacgagctcgccttcgacgtcatacagctcgatctcatagtcgacgtcgagagaacggaagacgtcagccagatcgtcgacgcgtgtgggctccaccacgccggcgaacttgggcatcccgccggagttgaagagattcagtcggcaccacgaacatgtgatttcatactcgtccgatgccgacctgcgggcagcccatcccagctgcgcgaacgagcccgcgagtgactccaggtcgaaggtgttgtgcatgaatccgtagacgttgttgtccaacgtgtcgagctcagcggcaaggtgcgcgctgctgggaacgccacccgacgttatcgacatcccttgcaccttcctgcgcggagtgcgccgcagcaccgaccgtctctgcgccgagattagacgcgtcaaccttacgggaccgcgctcagcagccgttccgcgtgggggaagactggtcggtcatagcaggacagacttgacaaatcagattccacagaacgccgtggcagaccgtttactggtacttcaaaacctggaccgaggacggcatcttcaccgacctcaactacgacctgaacgggttggtgcgtaacaaatccggccgcagcaccacatccacggcatccatcatggacagccagagcgtgaagacgtccaccaacgtccccaccgccagccaaggcatcgacgccggcaagagaatcgtcggccgcaaacgcggcatcatcaccgacactctcggcctgctcctcgccgtgatcgtcaccgccgcctccgtcagcgacaacacgatcggcatcgacctgctcaaccgggccacccgcatctaccccactctcacgaaggcctgggtcgatgccggcttccgcaccaaggtcgtcgaacatggcgccacgctcggcgtcgacgtcgagatagtcaccaaggacccgcaggtcaaaggcttctcagtgatcaaacggcgatgggtcgtcgaacgcaccatcggctggctcatgcaacaccggcgcctggcgcgtgactacgaaactctcccggccacctcagccacgatgatccgcatcgccatgatcgacaacctcaccaaaagagccgttcaactacccgacgagcagtctcggccgacgcggtttcgccggggcgggttccgcaccgctcgccaggcacagaccgcccgtaaccagacggtcgcgtccgccgccgccggtgccggaccgcggcgggtcacggtcgagcagtggttgcgccgctggctgctgagtctgcctgggcaggtacgccggtcaacggctgccggctacagcatccacgtgcgccggtacctgatcccgcacctgggccaccacaccctgacagggctacgagctgcgcacatcgaggcgatgttcaccacgatcaccgcacaaccgagccgcaccggcgcgccgctgtcggcggcgaccttgcagaagatccgggccaccttgcgccgggcgctgaacatggcgatcagggagcaactgctggcaatcaacccggcccggctcgtgctgttgccgcggccacggcggcaccgcccacaaccgtggtcggcatcgcgggtcgcggcctggcaggctaatggctgcaagccggtggtggcggtgtggacgccgcagcaactggccgagttcctgctcttcgtccgggacgacccgctgttcgcgctgtggtggctggcagcccttcgcgggctgcgccgcggcgaaatctgcgcgctgcgctggaccgacgtcgacctcgccgaaggcacgctgacggtcagccacaccatcgcccacgctaacggccgtccctattgggacacgccgaagaccgctgcggggcaacgcaccgtggcccttgatcgcatgaccgttgcggtcctgctacggtcgcaacgccagcagcgtcggcaggcacagtgcgccggcgagcggtggcgcccggacgggcccgtgtttacccgccagggccgggcgatccgcccggactggctgacgcaccgcttcgccacgctcgtcgccgcgtccgggctgccgccgatccggttgcactgcctgcgccacggcgccgcgacgctcgccctggccgcgcacgtcgacctgaagaccgttcaggacatgcttggacacaccagttatgccttcaccgctgacacctacgccaccgtgctccccgaccaggcgaaacacgcggctgagtcgacagcacggctcgtactcaacgctttgcacaaagcgtgcaccgctgcgggtgcagggtcgcagacgggctcatgatcgcgcctccgtagaaccttgccgtggccggccgaacggcttccagatgcctgagctcaggaccggtccttctgagtctcggcccaggccagtaccccgaataggtagcctacgaaatcgaatggcgtgagttgaagttcttccaggtcagcccacagtttcggatgggttgtacgaagcacggcgcagcagatgaaggcaaccgtcgagatggatacgaccttgctgatcttctcgacggtcgttacggtcggcagcgactcgcgcagtagcagccagagccaggaaatgtgccatgcggcggcgtctcgcacaccagcgtggccggattcctcaccggcttcctggagcaccgtcttgacttcggtttgaatgtcccgccaaaggtcggcgtatcccgatgacgccgtcacctcgtcggcgagctgatccagcgactcttctccgaggccgtccgcgacgatccgctggagtacatcgacggaggcgctcactgtccggtgcgtcaggtcgggattgatctgcgttatgacagtgctcagcgactccgccaggtcgtcaagattcggccgacaggcccgggcgaggccctcgatttgcccgggctccaagaccgccatgcgaccgagcggcgaggtgagcgactccgtgagccgaacgccaacggctggtggcccgatcgtttgcgccaggctgtcgtaccgcccggcctgatcagtgaagacgcggcctgcggtcgaggtcagcgattccgtgaactgcgttgcgccggcgaggtccgcggcgatctccgagaggcgggcgcgctgctgcgcctggtcggcggcgacctgatgtgccatgaacgacagtgcgtccttgtccatggccgcagctccggcaacctcgccgatcgtttttataagcttgtcgcgctgtccgatctggtcagcggtgatatggccggcgatcgaggtcagcgacttcgtgagctgcgttgtgccagtgaggttcgcggccatctccgtgaggcgagcatgctgctgcgcctggtcggcggccaccgcttcggccagcgccgatagtgactctcgcgcccgggcagtccccgtgatgtctccgatcaacttcgcgaacctgtcgcgctgctgtgcctggtcggcggctatccgaccgaacaatgaggcaagcggttcagtgaggcggaagatctctgggtcaccgaaaagcgaggaagccgcgaacgcctttttcagcggctcgtcgccgtgctcgctgctgcccaacaacgcctccgcgatcctgacctcccggggctccgggacttctccaagatagcgccgtccggcactgcgatcgggtgaccgggtcccgcaacatcacccacggcccgctggccgctatcgccgagatccccctcgactacgccggctacggcatcgtcgccctgttcttcctcgcctggatcatcgcgatcgccgtctggcacttcgggcgcgtcgaggaacgctggtcggccaacctcgcctccaacaccaaatagcaggcgacgccgctcacggtgcgcggccagcagtgatgacttcgtcctgctggccgcgggcgcacgccagttgatcaatctcgcgtcctggcaggcgctcgaatccgcgaccacaccgcaccatccccgcccatggcccagccggagaccggcggccggccgcggcatgccgtcaccggtgcggatcagccgtcaccctcacccggcggcggcgagggcggcccgcagtcggcgatcaacaaggtcagctcctgcaccagctcgtccatactttgcccggtctgcctacggaccaggctgagcgcgagctcggcaagcaggcagaagccccgggcctgcacctgcgcgtcgcccatcgccacgagcagttgctcggcaccggcgaaatcgccgcggtgtttggcggcgacgacgccggccgcctgctgggcggcgagaaaggcgagcccggggcctgccggaatcacggcgcgacgatgatcgggttgccggcggcgcgggccgcgtcgaaccgcttcgtcacgtccgcccagttgaccaggctccacagccggtcgacgtagtccgggcgcacgttcttgtactgcaggtagtaggcgtgttcccaggcgtcgaagaccaggatcggcgtcgagccctgcccgacgttgccgtggtggtcgtagacctgctccacgatcaaacgctgcgacagcggctcccacgccaggacaccccagccggagccctgcacgcccttggtcgcggtggacagctgcgcggagaacgcctcgaaggagccgaagtgctcgacgatcgcggcctccagttccccgtcggggcgatcggcgctggcgcccgggcgcaggttgttccagaagatcgagtgcaggacgtgcccggagaggttgaacgccagggtcttctccaggccgaccagagcggtgtagtcgcccttgtcgcgggcctcggcgagctggtcgagggtgtcgttgctgcccttgacgtacgcggcgtggtgcttgctgtggtgcagctccaggatctggccggacatggccggttcgagcgctccgtagtcgtagggcatgtcaggaagtgtgtagatcgccatgatgctcagtatgtcttattgccaactactggcaactactagatagttacatcaacggacgggatgttacgtcgtcgcgactgcccgacccgggcggtgctttgcgccgtttcgacaccgagaggcgctccggcccgcgatgatccacgccaccggagcgcctttcgatgaaccccgacctaggccgcggcgggcgaccgcagggaagccccgcccaccgccatacgggggcggtggcggctgccgacggccacacgccgcccaagccggccggtcacattaggcctgcgaagcggcgcccaaattcagccggatccgagcgtgcgagcgcagcagccctgccgtcgcagtcaccgctcgatcggccaactcccggaacaccgtccagtacgtgtccgccgtggtcaccgcgctggaatgtccggcctgacggcgcaggcccggcctgacggcgatggcctatggcgtgcgcagaaatcaaggcaaactaactagggctgccgggcttgctggcagaggtatcgcctgacgtgccggcgcgggcctgccttaaataagagaaggagcggatcgtcgtgccggcgatctgcttcgctactacctcatgatgcggtccgggctgtaagcggtccggggcgtgaatagtgaagccggatgcccacggggggaggcatccggcttggtcaccactataggcgccattggtcaggcggtaacaccgacgctgcggtgccccatcgtggcgttgtcataagacaaaggccgtcaaggtagggcgcgagcgggttcatgccggtgtggcctagctcgtactgccggtgaggtctttgagatacgtagcggtgatctgctggccgggcgcgggccggctcttggcatgatcggctctagctgtagacgatcggcgtcagttgccggtgatggaccagtgccaggcttcggcgggcaggttgacgaagccgtactgcttggcgtggcgggtcagccaggtgtaggcgggggtcttcttggtgatggttttgcctccggaggagatgtcgacggccaggccgatctcgtgcagggagcggcctgggatcgcggtcggcactcggcaggatgacggtggggcggtccagacgtcggggcagccgttgatggtgcgtagttcggcttggcgctgggtggtacggaagccgccgccggacatctggacgccgtcggctttcgcgtcgtcgatcatgtgttggaaggcgaatgcgatggttttgttgacggtcactccgtacacctgggtggtgtccgtgatggcgaaccccgctcggatctgggtgacgacgtcccggctgatggcggcggcctgggcggcgagtgttgcggcgctgggcagcgcggtgatcgcattttcggcgcggttgagccctgcggtgccgtcggtgactgcggtgctggcctgactggtgcggctggtcgcggcggtgaccgcggcgtgggcagtggtcagggcggcgacgcccttggcggcctcgctgttgcgggtggccacggtttgggtagcggtggtgaccgcgttgcgggcgcgggtgagggcggcggcgttgcggggcttgcggtgagagacggtacgcaacgtccgctgcgcggtggacagcgcggcgcgggctgcggtcagctgcgcctgggcctgggtgttggcggtggtcgcggtggtcagcgcggattgcgcggtccgcagagcgtcggtggcggcggcgagttcggtgtcagcggcgcgcctgatggcctgctgggcggcgagcgaggtgcgcagggtggccagctgctcgtcgtgggtgaggctgcggtacatcatgctggaccaggtggctgccgctgttggagctgcggccgcggctggtgtgggcgggctgatggcggagccggtggccgtcatggcgatgatcgtcgcggcggcgtacttgcgcagagttcgctgtcgtgtcgtcatcctccgaccgtgaggtgcggcgggttctgtggccggtccggtcggggatcgggccggttgcgaatggtggatgggatcgaagccggaggctggccggctatccggggtacggttcggctgccgcagacgtcgccgtcgccgaggagctggtgttcatggccggtcatcaccacagccacgccgcgccgggtggggtgtcgctgccgcacgcgcgtcgtttgacggtggcgctgctgatcccggcggtgttgctgaccgctgtgggcatgttgttgctctggccgcggcatccgccgaaggccgagaccgctgcgggcgggccggctcaggcccagggcgtggtgctgtcgaccgcgacggccgcgtgtgcgccggtgcccgcgggtgagacacggccggccggctgcggcacggctgtcgtgcggttacgcgacggtgcgcaggtcagcacggaattgccgtccgggccgggcgccccggtgatcagctccggggatcgggtgacgttgatcggtttgcaggatgagcggggttcggtgacctggtcgatcgcggatcatcagcggtcgcgggagttgtggctgctcggtgtggcgttcgtgctggcggtgatcgcgttcgggcggtggcgcgggttgagcgccttggccggcctcggggtgaccttcgcgatcctgctgtatttcatcgtcccggcgatcctggacggccggtcgccgatggcggtggcggtggtcggctcggcggcgatcatgctgaccgtgctgtacctgacgcacgggctgaatgtcaccacgacgatcgccgtggccggcactctggcgagtctgatcatcacgacggtgctggccgagatcagtgtcgccgccgtgcacttgaccggtgtctccgatgacacgtcgaacttcctgtcggtcagtcagggcagggtcaacatgcagggactgttgctggccagcatcgtgatcggttccctgggcgtgttggacgacatcaccgtcacgcagtcggccaccgtgagcgagctggccctggcgaatccggcgtacggattccgccagctctacggtgcggcgtcccgaatcgggcgggcgcacatcgcgtcggtgatcaacacgatcgtgctggcctacgcgggagcgtccctgcccctgatgctgctgttcgcgaccggtggcacaccggtcggtgacctgctcaccgggcagttgatcgcgcaggaactggtgcgcagcgcggtcggcacggtcggattgatcaccgcggtgcccatcacgacggcgctcgccgcgctggccgcgcaccggatggcggcgccgtcggcgaagccggcagaaccggaggctgggcgatcggcgcggcaccgcctgcccccggagcgtccgtgggctgcttccgagaggtgacaaccggcgtttcacttccgtgcccccttgttcgtggagcatctgcatgctgccggccgccgggtcctggccatcgacgctgacgtgatagggacgacgggcccgtggcgggcatgccgcggacccgtccatggtgcggtggattcagctgccggcgccgatctcgacggagccgtgaccgacgacgctctggtcggtgaccactgtcatcggaccgaacagcttgcgaccagtctgcgcgcggcggtggcggtgaccgtcccggtcaccatggtcgactgcccgggcggcaagcgttaccgggtcgccagcacggtgagtaaaccgggcaacttgctgtagtagacgtcgcggtagtcgtaggccgtgctgccgctggacacggcatagccatcggccacgacggtataggtgtcggccgccggcgcggtgatcgacacacagcttccccgggcggcagggcgccgccttcggtcgctcattgacgtgttcgttaccgagcgccccaccggcggtggcaagcgttaggcgctcgcccggggacaccgtaccggcctgttgcgtcacctaaagcaaatgaaaaccgttaccgttatcggtgctggggcgtcgcggccaatgtctgcttgcggcgatgcgcatgcggcacgcctgccctggcgcttcatcagttgctgaccactgcggtacgtgttgggagagttgaggatgtcaagcccgcgaggcatgagccgggtcgaggcccgagaggtgaccgtcgccctcgccggaccaggggatctggtcgaggcggaggccatgatgcgggaggtgttggaggcggacctgggcggctatcggccgcagtggcaccgcgacctcgacgatctcgaagcggcgtatctgcgtagtgccgggtgcgcactgatcgttgcccgggatccggacggcatcgtgggtacggccggggtcaagccgtgcgcgttggcgagtccgccgaatccgcagtggttggcgcaccggtacagccagcccgacgtgtgtcagttggtgcgggtctgggtggccgcaggcgggcgacgccggggcgtcggtcgcgccgtcgccgaacgggccgtcgcgtggagcgtcggcccgggcggatatcgccgcgtgtacttgcacaccgatgccagcgttcccggcgcggaggcgttctggcgttcgctgccgactcgcgaggtttgcgacacccggcctgatccgttcaacacggtgcacttcgagatcgacgtcgccgcgatgctgcggacgtcggaatgttgagcgtgccggttgccccggcccgcgacgtcgacgagcgtgtgctggctggccgcattctgcgggtgtacgacgggctgcgcgcccaggacagtcttgccccgtcgcccgaggtcaactccctgttcgccgacctggtctcgatctgcgcccacgctgatccggccgatgcctcctcggcactgaccgaccctcggatcaccgaggcacgcgacggcctggtccgattgtgtgccgagggagaatcccggctcgaacaatggtgggcacgccgcactcttgccgccgccgacccgcacgccgagctggccgccttcccgtacctgcgcaactaccagcaactggcgcacctcgaacggcatgcgctggcgggaaccggccaccggcccggagagtcccgtcggctgtgtttcctcggcggcgggccgctaccactgagtgcgatcatgctctcccgcatgctggacactcaggtcacggtggtggaccgggatgccgacgcggtcgcgttgtcacgccgccttctcgatcggctcggcctcgcggaacagatcagcgtgctcctggccgatgccagctcggcatccgacctggcgtacgccaccgccagctgcgacgtcgtggtggtcgccgcgttggtaggcaccacccggattgaaaaacaggcggcgctccgtgccgtcggcacggccctcgaggcggacacgcgcgtgctgatccgcagcgcccagggactacggtcgctgctctaccctgtcgtcgacgtccgagacgtgcacgatgccggcctcgtacccgaagttttgctgcatccgttcggggaggtcatcaactcggtgttcgtggcccggtgtcgttgacgatctgccggccacgcagcacgacgtcccggactcgggtcagggctagaatgtcgcgctccacgtcaccgtcgacgatcaaaaggtcggctgccatgcccggccgtagccgtccgacggtaccggccaggccgcacgccgcggcggcacccgatgtcgcggccgccaccgcggcgtgcaccggcagcccggaccgaaccaactcctcgaccgcgtaggcgagcacaccgtgcggcttggccgggtggatcccggcatcagaaccggccaacaacggcaccccggccgcgtgcagccggccgacctgcgcgaaccgggcctccaacgtcatgccggtccggcgcatgacctcgatcgcctgcggagacggcggcagcccgggcaaccggccgaacgtcgggcacaccgtgacccgacgtgcggccagtgcgtcgatcaccgcgtccggcgtggcgattcctgtgtcggtcaggcaggtgcagtgttcgatggcgtcgacgcccgcggccaggcacacctgcacggcggacactgggtgggcatgcgctgtcacgggcagccctcgacggtgcgcttcgtccaccacgtcgcgcacctcagcgacgtcgaactgcagccgcagcagatccgagccggcggtcatcgcaccaccgctgacgatcaccttgatgatctgggcacctcggtcataccgctgcgcgaccgcggcccgcaagcccgcccggtcgcgggccgcgccgccgagcgcggcgcaatgaccgccggtcgaggtgatcggcggccccgagcccacgaccgacggttcgtcgtctcgaaccgtgcggtccacgaccgcgaatcggttgtctcccaggtcgcgcaccgtcgtcacaccggcaccgacctgcgccagcagggaacgacgcacgacctgttcccgttcagcggcggaccggcccgcatcccaccgcaaggcgtccggctcgccgccagccaccagatgaacatgggtatcgatcagaccgggcagcaccgtgcatcccggacggtccaccactggctgaccagccggcaacggctccgcataggcacggacagcggcgatacgattggcggcgacatggacctgcaacccgccagggatgaacttctctccgtcgaacgcgtgagctgcccggtagaccacagatcctgccatccctggaaactaccgtccttcatcgatcactagtgatctctcccgcgctatgacgcgaaggagccggaaccaaaacggcttccgtcgtcggttagcgccgtcactcgactctcgcgagcgcggctgacggcgcgccgcagcctcaccgaaggcgagaaacccgcttcgggctgtcccgggaaggttccgcgaactggccgcacggcaagctgcccggcgtacgaaaagcctcctggtaagcgggctgccggctttcccgggttgccgaccggggaggccgcccgccagctatggccgctgtcagacggtacgcaggtccaggatgtgccacatgacggtgtcagtgctgccggtggaccaccacagcaccccggcccgtgtgaacgcggcgctgacggcgggactgatgtcgacggtggtgccggtgctgatgtcgtacacccgcagggcggcgacgccggtgacatctgatcccggaatggtctgcgacaagatttcgaagcggtcgaggatcgcgacgtcggtgacggcggcggaggcgtcggcgccggcgatgcgacggcgggcggagccgtccgggtgcatgaggtcgatccggaccagtccctcactgccggaaatcatcaccctgcaccaaacggggctgcactcggctgcgtcctcagccgacgtggctacctgcacgtcacggccggtgttgaagttccgcatccgcaacattctcgatgggcccccagtggaatcggtcagccacggccatgtggtcagggcccaggtgccggattcccggcgggcggtgacagctccaccggtcagagcgaccgatcgaatctcggtgtcttggccctgcttcagagcggctgcccaatacacccggcctccggcaatgacgagatcgttctgcgtgccgtagaagacggtgtcgccggtgtcggccgtcagtcgatgcgccggtcgtccgtcacgcgtattgaccgaccagatctcggtcgatcctgcatcggttgactcggtccacacgacgtcgtcgccggccaccgcgaaattgtcgaactgcggggccgcgtcggccggctggcggcgcagctcgcgcaggccgccggtggagcgcagcagcagccgcacctggcgaccgtccccggtcgccgccgttccgatgacggtgtcggcggccaggaacagatcgggattgaaccgggtgccgtcggccagcgtgccgggcaggtctgcccggcgtgcgtgcggccacgccgcggcgacggtgaccggaccggcggcaggcgcggagttgctgcggcgcggggtcgttgacagcagtacaccgccggccgcgagagcggtcaccaggacgacggcggtacgacggctgggacgtgtcggcccggtccggggcggggcgctgctcatgcgtacggctgcttgggttgtgcgatttgctgccagctcttcacctcgacgtacgcgatgggggccttgttcaccgggtccgtgccggtctgcgtgctgtagacgccgataatctcgacccacgtgtcggcgggcgcgtcgatcggggtgccgccggtgagtcccaccttgatcggctggccgtccgcggcgcagcagatcagcacgatgcgggtcagcatcggcttgcctgccgcgtccggggtgatgaacccggtcatccgcacggtgcgcccggccaggctcttacctttgtcgaagatcgcgcgggaagcgtagtcgagcagattgaccgtcaccggctcccccgcgggcagcggcggatagtccgatgtggtgtccggttgcacgctgacgctgcccgcctgcttggcggtgtaggaacccagcgccggaggagagatcagcagtatggccaggaccggcagaatcagcagccagccgacggccggctcatgctgcccatggccgtgcccgtcgtcatggtggccgtcaccgccaggccgccactcgtgccacagcgtcatgaccgcggccgcgaccagcaagataccggcgaccagcaggaatggccgcaagccctccttgacgtagcgcaggaacacgtcggtcagggtggccctggtgatcgcgccgccgaacaacagcatgatcaccgcctgggacatgcggttcacagcaacaccaatccgaagccggtaccgaccagcatcgccgcaacgaacgtggccggcgcgaaccggaacgcgaagcggcggccgaaaaccccggcctgcatcgagatcaacttcaagtccaccatcggcccgaccaccaggaacaccagccgcgaggtcagcgagaactgcgtcagcgacgccgccacgaacgcgtccgcctcactgcaaatcgacaacaacaccgccaaagtcgccaaagcaatcaccgaaaccaccggattaccggccaacgactgcaaccacgaggccggaacgacgacattgatagtggcggccgccgccgcgcccagcaccaggaacccgccggcgtgcatgatgtcgtgccggcacgccgcccagaacgcccgcgacctggagctgtcgtcgaggtccggccggtgcggcaacttgatccactccgtcttgcccagccgcagccacagccagcccaccgcaaccgccacgacaaggctggccaccccgcgagccacggccatctgcggcctccccgggaacgcgatcaccgtcgcggtcaacacgatcggattgattgccggcgccgcgagcaggaacgccagcgcggccgccggggtgaccccgcgccgaatcagcgacccggcgatcggcacactgccacactcacaccccggcagaatcacaccggccacaccggccgccggcactgccagcgccggatgactcggcaacgcccgagcccagaaacttcgcggcacgaacaccgcgatgactgcagacagcaccaccccgaacaccagaaacgggacagcctgcaccagcaccgagacgaacaccgtcgcccaggtctgcaaccccggcccggtgagcagaccggacagcttcccgcgcaccagcaccaacacgattagcaggccggcgaggacttccagcgagccgatccctgcctccctacggcggcccggctgcgggacctcgctttgcccggcaggctcggacatcggtcgggggtgctcgtgactgtcaacgtcagacgtggtcacggtgtgctccgacgaactcaatgaatcggctccctgcgtacgccggaatcggcccggaacggcaatataaaataccttcctttgcggatttgacaatgacccctgcactccagagaggtcatcggtaaatgattcaacaattgctcatatgcccaacagtgcatatctttgtggcttcgtcgtcgctgggcaggcgggcagcgtgagcgtgcaacctgacagcgcttcggcttatccgccggtgcccgctcattcgcgggcgtagcgcaggacctcggccaccaggcggttggtcgcctcgtcgggcagcgagtagagcacccgctggccccgccgccggcgtcggaccagacgcgcatcggcgaggtgacgcaggtgatgcgcgacgactgtggtgtgcaccgcgagggcggccgccagctgtgtcggggtcgcctcgccgtcgcgcagtatgaccaggatatgcaggcggtgctcgtaagccatgccgcgcatcgccgccgccgctcggtgcagggcggtctcgctgaccgccggccgcgcggtcatgcccgcaccggtttcgtggacccggcacgatgggcggtggctcgttgcgcggccgggcgcaggcgggtggccgtccaggagatcagcaggatggcggttgcggtaagcgagatgctcgcgccggcggcgatgtcgaaccggccggaggcccacagtccggccagtccgctgccggcggcgaacccgacggcgagcacggtcatcaccggtaggcggtcggtccacagccgggccgccgcggcgggcgccacgatcagcgacaaggccaggatcgtgccggccgcgggtaccagcgtcaccacgacgagctcgatgctcagcagcaataccaggtcccaggtcccggtcgacaggccagccgcctgagcgccggtgcggtcgaagccgaccagcagcagcgggcgggcgaacaccgccaggacaagcgccacgacgacgagcgcgaccagtgtggtgatcaggtccgcggtggtgacggtgaggatcgagccgaccaggaacgcggacaggtcgcggctgaacccgttttgggttgcgaccagcgcggcgccaagagcgaagccggccgacagtacgaccccggtggcggccgcggcgtcctggccgcggcggctggtcagcgccgccacgccgagcgcgacggctgccccggccacggcaccgccggccaggatgttgactccgatgatggaggccgcgaccacgccggggaacgtggcgtgggtcagggccatggtgaagaacgacagccggcgcagcaccacctgcaccccgatcaggccggccagcgcgccgaccaggatcacctctgcggtcgcccggtgcagggcgtcagcccaccagctcatgcgcggcactcctctgcctcggaaggggcacgtgacgccgacggcggcgatcacggatccagcggacggggatcagcaggcagtacgccgcgaccagcagcagcaccacggccgaggcggcggtcagggacacgccgtagtccatggaggcggtccagctcagccacagtccgccatagccggcacccaggaccagcacggtgccgaggatggccatcgcgaccagccggtcggtgaccatgcgaccggccgccgccgggacgatcagcagcgcgaccacgaggatggtgccgaccgcccgaaccgccgcgaccaccaccagcgctaccaggatgttgagccccaggtcgagccagccgacccggaaacccgccgcggcggctccggccgggtcgaaggtgcgaaacagcagcgcccgggcgccgatcagcagcgccgccagcacgacgacgaccaagaccgcggtctcggcgatctgccgcggcgagacagtcagcaaccggccgaacagaaacgaggtcaggtccgcggtgtacgacgctcggcgcgaaaccagggccaccccgatcgagaacatcgcggtgagcaccacggccgtggccgcgtcatcggagatccgcccgccgcgggtcagcagggtcagcacgagcgcggtgacgaccccggcgaccagcgcaccggcgaacagcccctcgatgccgccggccaggaacccgacgaccacaccggggaagatcgtgtgggtcagggcgtcggagacgaacgacagccggcgggcgaacacgaagacactgaccggtccgcagatcaacgccagcagcgcgatctccgtgagagcgcgggccatgaacggtgcggcgaacggttcgatcatggttccaccagcaccatccggccgtcggccagatcgatggcgctcccggcgtacgtacgtcgcaggttgtcggcggtcagtgtcttagcgggcgccccggcggcccactgccggccgttgatcagacagacctgatcggcgaggtcgcgtgccacctgcaagtcgtgggtgctgaacaccagagcggcgccgcccgcagacaactcgcgcagcacccgcacgatcgcgtcctggctgaccgcgtcgacgccgttgaagggctcgtcgagcagcagcagccgcggctcagccgcgatggcgcgggcgagcaacacccgctggcgctgcccaccggagagcgtgccgaagcggtgagcggcccggtcaggcaggcctacctgctcgagggcgtcggccaccgcctgccggtcgtatctgccggccgggcgccaccagccgatccgacggtagcggcccatcatgacgacctgccggacgctgaccgggaagtcggcgtcgagggtgtcggtctgcggcacgtatccggcccggccccgggccgcggccgggctgtcgccgagcacggtgacggcaccgcccagcacggggaccaggccgagcatcgacttgatcagggtggatttgccggccccgttcgggccgaccagcgcgaggcgctggccgggcgcgagggtcaggtcgacgtgggtgagcaccggggtgccctggtagccgatgctcacctgggagtacgtgaatgccgcggtcatgtcagccggccagcgcggagacgatgacctgggtgttgtgctgctcggcaccgaggtaggtgccttgcggggtgccgtcggcgccgaggctgtcgccgtacagggcatcctgtccggcgacgatcttcacgccggtctgcgtggcgatggcctcggcggtcttgggcggcagcgagctctccgtgaagatcgccttggtgccggtcgctttgatcttggcgaccaggtcggtgagctgctgcgccgacagttcggcggaggtgtccatgctggggatgaccgagccgacgaactgcagctggtagcggtcgacgtagtagccgaacgcgtcgtggttggtgaccagtttgcggtcggcggggggcagcgtggcgaaggcggcctggttgtcggcgtcaagcttgtccagcttggcgcagtagccggcgaggttctcggcgaacgtctcggcgcgggcggggtcggccgcagcgagggccttctcgatgttggtcaccatgatcttggcgttttgcgggttgtgccaaatgtgcgggtcaccgtcggccatctctgcgtcgcccgggtcccccttgcgcagcgcgacgccgtggctggagtcgaccacggccccggtgaagccggccgacgcgatggtctggtccagccaccgctcgaggccgacgccgttcttgaccactaccttcgcggcactgatggcctggatgtcggcgggcgtgggctcgtactcgtgggggtcgacgccgaccttgatgatctgggtgacggtgacgtcgctgccgccgatggcgcggacgaagtcggtgacctccggcgtggtggcgacgaccggcagcggcttgccgccggagccggccggggcagctgcggcgtcgccgccggagccgcagccggccaggacggtcgccgcggcggtcagggacgcgagccaaagcaaggggtgcctgaatgtcattgattccactcctctcactgaggagcagaacgataatcgttttcaataactatcgtctaatagcgacatgactatcagttcatccgccggcgagcggtcacccaatcccggccagtaggtccagcagccggtcgatctactcgacgatgttgcagatgtggccaactcgcccgaacgggatgcggttgcctcaccaccgtcggcccgacggcgctcatcaacgcgggcggtgcggcgctgccggttcaacaacagtgacctcggccaagatgacggccagaacccgttgggcggtgctctcggcagccggcccacgcgggcggcgatccccgctgctcgccgaacttgccgtggcgatcgccggcagtgagaccggtcgcgacccgcaggtggtgatgcgtggcatctccctgcggatcgcggtcgcggacaggaagagcaggccgatggagatccacaggccggtggcggcgtgccagccacgggtgcggcgcacgctctggcatcaaagggcggggagttacgtatcagtgaccaccgacctgggcggtgcttgcaccgtgtcgacaccggaaggcgctccggaccgcgatgatccacgccaccggagcgcctttcgatgaaccccgagctaggccacggcgggcgaccgccggggagcctcgcacgccgccgttcagtggcggctgccacccaatccggcccggcacatcaggcctgcgaagcggcgcctagattcagccggatccgagcgtgcgtgcgcagtagccctgccgtcgcagccaccgcccgatcggccaactcccggaacactgtccagtacgtgtccgccgtggtcaccgcgctggaatgcccgagatcatgctgaatcaccttcagctcgacacccgccgcacccgccaaactcgcggcgccgtgccgcagatcatggaaccggaccggcggcaacccgaactcggcaaccagtgcgtgaaagcggtgggtgagccagtccggccggaccggccgcccgtccgcgtgtgtgaataagtatctgcgcggattccggtcagtgccggcgaaccgagcttgctgccggtcacggtgctggcgcagcaactggttggtgaactcgtccaacgccaaaacccgcaccccggccgccgacttcggcggccccaagcgcaccttgccatccacgatcagcagctgccgctcgacgctcagctcccgaaactcggcgttcaggtccatggcccgcagcgcagccacctcaccgcggcgcagcccgcgcagcgcgaccagccaccacagcgggaacagcggatcaccctcgaccgcttccaggaacttcgcgacgttctccacgtcccacaccgcgaccctcggccgggccccggtagcccgccacaacgcctccctctcccgcgtccacgccaccgcctgcggccgggcaccggtcggcagccgcaatcgccacgccgcgttcgacgacaccaggccttggcgacgcgcctcgctcaacgcactgcgcagcaccgcgacaacgcggtgcaccgtgctcgccgccaccaggtcaccgtcgcgcttctcctgccggccgatcccatcgaccgcccgctgaaccaacttcgcaccgcggcgcccgtccagctccgccacccgataccggcccaaccacgggaccagatgccggtacgtcaccgaccgatacgcccgcaccgtcgacggccgcacccggtcctcgatctgcgacagccagaactccagccaccgcttcaccgtccacgtctccgccatcgcctccggccccggcaactccagaacctcggccagcccccgctcagcttcagccctcgacgagaatccgccccggcgcagccgcttctgccggccatcagcgccaggcacgtgcgcgtcgatataccagcggccgtgccccacctgaccaaggcgcggacaccgggcgcccaactgcttgcccgtctctgccgaccggcacgcacaccgcgcaaacaccgtcccgttgctggtagcagccattatgacgacccaccacgcaggcaggaaagatcacgggtcgagcgtcgacccgcaacgcaccacgctccacgacaccttggattgaacacgttctaactccttgacgagtaagaacttccaacctcaagatccggcccgagccccagcggccaccaccaagcagagccaggtgaggcacgaccgtgccccacaccgccccacaccgcccaccagcggactatgacgcccggacgttcgtgctggtggaacctggtgggccgcccgggactcgaacccggaacctaaggattaaaagtcctcagctctgccattgagctagcagcccgcagggtgacagagtacctggcaaagcgaacgaagcctacgcgatacccacctcaacgcctttcggccccttcatggtgtacgcccacccgctcagaggccggccagcagaaacccccgcacgtcgctgcgggcctggtggatccgggatttcacggttccttccggaatacccaggtgttccgcgatctcccggtagtcgagctggcagatgtcccgcagcaccatcggcgcgacgagttcggcgcggcggttctccaggcgttccagggcgtccagcaggtcgagccgggagccggcgatcacgctggtggtgcgcgggtcggcgacgtcgatcggggtctcgtcgtgggactgttcggcggcccgccgcttgagcatccggtaggtctgccgggagctgtttgcgatgatcacgtgcagccaggtgctgaatttggagcggccctcgaaaccggcgatgttgcgcgcgacctgcatcagcacgtcctggcaggcttcctcggcgtcctggtagcagggcaggaaccgggcgcagcgccgcagcaccgacggctggatcaggccgagcagcgattcgagtgccgcccggtcgccggcggccgcgcgccgggagaggtcttcctgttcctcttcacgcaccgctgattccccccgtgacttcgatgctcataatacgatcgtgcccgcacctatcatgatcggtcgatatcgagtgacgcgccgtctcggctcgggcgcgttcgccaccgtatggctggccgaggacgacgtgctcgagtcgtacgtcgcgatcaaggtgctggcggagaactgggcgcaccatccggatgtgcgggcccgtttcgagcaggaggcgcaggtactgcgccgggccgattcggagcggctggtccgggtgcacgatttcggtgagcttgcggacggccggccgtatcaggtgatgacctatgccggtggtggcacgctcgccgaccggctggaggcgggcccgatgccgctgggcgccgcgctgcggaccgcggtggcgatcgccgacgcggtgaccgtcctgcaccattcgggcgtcctgcatcgcgacctgaagccgtccaatgtgctcttcgacacggtccggggtcacgagcgggtgctggtcgccgacctgggcctggccaaggagatcgcccaggcttcgggtttcaccgtggtggccggcactcccggttacatggcgccggagcagagccggcccggtggcggcctggacgtgcgcgccgacgtccacgcgatcggcgcgttgacgtatcagatgctgaccggcaggacgccgttggagggccgcggcgccgctccgtcccggctgcggccggggatcccgcggcaggtcgatcgggcggtgctgcgcgcgctcagcaccgaccgcgaccgccggttcccgtcggccgaggccttcgcctcggcgttggatctttccgggcggcgccgtccgctgcggtccttcgcccgattcgccggtacgtcgttggccctggccgccctcgcctgcaccaccgccgcgactctcccggacgccaccccgcccggttggacccgggtgggtgacgccgcccgtgcgatctccgtcgcggtgccgtcgtcgtgggcccaccagatgcgcgacagcggctgggatccggcgtcgctgggcctgcccgccgcgcactggcccggtctgcaggtcggcgccgacctgcgggacccggccgccatcactcccgcggtgctggccggcgccggtgactggacaggccggttggtcgccaccaccctgccccggcaccgggcctgcacggagcagccgccccgcccggtgtcggtcgacggcttgaccggccaggtgcgccgctggacgagctgctccggcaccgcggtgtcattcagcgaggtgttgctgaccgcccccggcggccgcggcgcctacctgcagatccgtcaggacggcccccgcgaccgcaccgacgagttgctccgcacgctgcgcgccgctcactcgtaacagtcctggtgcgcgtgctccacctccagttcgacgaccttgtccttcttgacgaagaagcggtagttgaccaggtcggtggaggttgcccaggcgcgtcccgtccggctctgcacggtgccgtcgacttcgctgggcttgaagcgtttgccgtacgccttcatcacctcttccagtgtgctgccgaggtggatgccctccggagtacggatgtcgccgtacgcggagatcgcgatgatccctttcccgggcgagtgctggacgacggcgtcgtcgtggcctttgaggtgggacgtggtgcacgccgtactcgcgtgatatccgacgatcatcccggtggccagggcgtcctgcgccgtcatgccgatcttcagggcgctcaggccgtcgggaccgaggatgagccgcttggccggcgccggatcggtgttgccggtcgagacgacgcggacggccggcttggtggtgggcgtagtggtggtggggctcccggcggcggccggaggcggcgtcgtggtcgccgagacgattccgccgatcggcgccgcttccccgctgacgacgtccggcttccgggtgcacccggtcagggccagggacagcccggcgaccgcggtcagcgtggcgatggtgcgtcgcatccgtgttcctcttcctcagagctctctgtgtcgctgtcatagggtgcgatgcgccgtttccggccccggttctgggatttatgtaacgactggataacgactcggtgccctgttcaatctccggccacccgatggacgggtagatcgggaatccttcctgctcatgcaacgtacttccggaatcgccgcgctcgtggccctgaccacgctggccgccggcaccccggcgttcgcttcggagcggcgcccggctcgcgagatcaccgccgaggcggagaccgcggcgctgcacgacgacgaccccgggggcaacggcgacaccgacgacgcggctgtctgggtcgatccggcgaaccggaccggcagcctggtcatcggcaccgccaggaacggcggtctacgggtgtccgacctgaccgggcgcgaggtgcagtcgatcgccacgccggacggcggccggttcagcaacgtcgacatcgtctccggcttccgcctagccgggcagaaggtggacctggccgtcgtcaccgaccgcggactggaccggctgcgcgtctaccggatcggcgcgagcggcctcaccgatgtcacgtcggctgacgccccactgctgttctcccgagaccaggccgaggtccgggcgcaggcaaccggctacggcctggccacctacggccggtacgcggtggtcagccgccggcgcaccacccgcctcggcctcttccgcctggaagagcggcaaggccgggtcacctaccgcacctcagacaccctggacctgccgagctcgttccgcctcccggacggcggcacctggtcaccgtgcgcggaaccgggccagggcccgcagatcgagggcctggtcgtcgacgccgaggcgggcgtcctctatgccgctcaggaagatgtcgccctctggcggatccccctgaccggcggcacgttcagcagcattccgcggatcgtcccctccagcagcctgccgcgaaccgtcgccttcaggagcctcccccgaaccggcccgtccaggagcctcccctgggccctcgacgccgggaaaccatgcgacaccaccgcgtcggtatccctgccgggttacccgaagggtctcctggtcctcccccacggcgagaacatcacgaccaacgaccgcgccagcaccgacttcaagttcctcgactggcgcaacctgcagatcaccacgttctaaaacccgattacccggtacgtcgaaaagcgcctccctagctagctaggtggttaagccctcggcctattagtaccggtcaactcaacacgttaccgtgcttacatctccggcctatcaacccagtagtctagctgggagccttacccactcaaggtggtgggatacctcatctcgaagcgagcttcccgcttagatgctttcagcggttatcccttccgaacgtagccaaccagccgtgctcttggcagaacaactggcacaccagaggttcgtccgtcccggtcctctcgtactagggacagcccttctcaagtatccaacgcgcacggcggatagggaccgaactgtctcacgacgttctaaacccagctcgcgtaccgctttaatgggcgaacagcccaacccttgggacctgctacagccccaggatgcgacgagccgacatcgaggtgccaaaccatcccgtcgatatggactcttggggaagatcagcctgttatccccggggtaccttttatccgttgagcgacaccgcttccacacgcaagtgccggatcactagtcccgactttcgtccctgctcgacccgtcagtctcacagtcaagctcccttatgcacttacactcaacacctgattgccaaccaggctgagggaacctttgggcgcctccgttaccctttaggaggcaaccgccccagttaaactacccaccagacactgtccctcgacccgatcagggccgcaagttagatacccaaacccaacagagtggtatttcaacaatgactccacccgaactggcgtccgagcttcacagtctcccacctatcctacacaatcgaattcagataccaatgtcaagctatagtaaaggtcccggggtctttccgtcctgccgcgcgtaacgagcatctttactcgtactgcaatttcgccgggcctgtggttgagacagtggggaagtcgttacgccattcgtgcaggtcggaacttacccgacaaggaatttcgctaccttaggatggttatagttaccaccgccgtttactggcgcttaagttctccgcttcgccccgaagagctaacaggtccccttaacgttccagcaccgggcaggcgtcagtccatatacatcgtcttacgacttcgcatggacctgtgtttttagtaaacagtcgcttccccctgctctctgcggccataccacgctccaccagcaagtggcttcacgcgtccggccccccttctccctaagttacgggggcaatttgccgagttccttaaccacagttcacccgtcgcctcggtattctctacctgaccacctgtgtcggtttagggtacgggccgctcgaaacatcgctagaggcttttctcggcagcataggatcaatgacttcaccagaacggctcggcatcacgtctcagcctcatgcaccgcggatttgcctacggtacggcctacacgcttaccccggcacaaccaccggccgggatcatctaccttcctgcgtcaccccatcactaaactactaccctagctagctagttcgcccgacccgctttcgcggcccggcgcccggggcactcgctctacgttactcggtccgttcggcgttgtcaaccggtttttcccggttggtgccgatctgacctagtacggccgctctgagctcagcacacagcgaggctgtagtcccaagatcagaggatttggcaggacggccgcggatcttgctgggtgaccccagaagttcgctcgcccgtttccctaccggcccggaaaacattacccgttggttccctggcctccaaatcggggtccagtgtcccgcgtcgttccaggtcagcgcaggaaaacgagcaaactcgggccggcgcggggataccggcaacctcaggcccgcacagcgaaggcgggaaccagcaacctcaggcccgcatgagacgaccggcaagttcaggccagcgactgaagcgcctgccccagcccccgatgaaacgtcgggtacgcccagatctggctgagcaacgtcgacaccggcacctcggcgtgcaccgccaccgccaccgccccgatcatctcgccaccggactgcccggcggtcgtcccgccgaccagcactccccgctccccgtccgcgacaagtttgaggaatccctcgttccccggcccgtggatgaaccctcgcgaggtctggttcagcggcacgtaccccacccgcacctcgaggccggcgtcccgggcctgctgctcggtcatccccaccgccccgatctccgggtcgaggaaggtcacccgcggccgcgcccggtagtcggctcccgggccgccctgccccaggatgtcccgcaccgcgatgtccgcctcgtacatcgccatgtgggtgaacgccccgttcccggtcacgtcccccaccgcccagatgccctcgccggcgcgcagccggtcatcggtggccaggaatcgagccgacgggtccagccccacccggtccagcccgagcccgccgagccgggccgcccgcccggtcgcgaccagcagcttctcgccggccagcacgctgccgtcggagagggtcacgtggaacccgtcgtcgtgggcgaccttctgcgcgcgcaccccggtgacgatccggaccccgtcggcggtcagggcggcggccgccacctcggacgactccggttcctccatggccagcacccggggtgagccctcgatgaccgtcacctgcacgccgaaccgggcgtacgcctgggccagctcgcacccgatcgccccgccgccgagcaccagcatcgatgcgggcagggccgccgcttccacggcctcacggttcgtccagaacggcgtaccggacaggccctcgatgggtgggaccacagcggcggtgccggtggcgatgaccacgccgcgcgaagcggcgaattcctggtccccgacccggacctgaccgggaccggtcagttcggccgtgccccggacgaacgttccgcccttaccggtgaaccgctcgacggcgaccttgtcgttccagtcgtcggtggcctcgtcgcggatccgtttggcgaccggcgcccagtcggcccgcaccgtggacgtcccggcgaggccggggatccggcgggcctcggccagcgcgttcccggcgcggaccatgatcttggtggggatgcatccccagtacgggcattcgccaccgaccagtcggtgttcgacgccgatcacgctcaggccggccgcggccaggcgaccggcgacctcctcgccgccgacaccgagcccgacgaccaccacgtccacttgccgcgcttcagacatgaccccacctaagcagaaggaccgtgcgccgattcctcatgtgccgccggccacgaccgattctggaccctcgcggaggtaccgagaaggcgggcggtcatgagggggcgatggtgggcgtcggctggcgcccgccatcctcatggccgccttcccgcatgaggtgatcgaggcctgggtacgccacgcggggtccaccggcgagtacgtgtgacggacgcaaccagccggtggaccccgcagcctcagtcgcgcagccagaccgcctcgtcccgatgtgactccaacggtccgggatagtcgagcccgcggcgtaccgattccggcagtcgccacggctgatgcaccgtgacaccgtcgatgtctttcaactccggtacgtagcgccgaacgtacacgccctgcgcatcgaatcgctgcgcttggcgaatgggattgaacctgcgatagggccgggtgtcgttgccggtgccggcggtccactgccagttgccggagttgttcggcacgtcgccgtcgagcagccagcggaagaaccattgcagcccgggccgccagtcgatgcccaggtgtttggtgaggaacgcggcggtgatcagccgggcccggttgtgcatccagccctccgcgcggagctggcgcatgccggcgtcgacgatcggcaccccggtcaggccgtcctgccagtgacgcagcgcgtcgtcgtcgtatcgccagttctggtccgccttctcccgcagcggccgggtggagatctccgggaaggtcgcggtgacctggtagtagaagtcccgccagcacagttgccgcaggtaggcctgggcgccgggagagtcgtcggctttcgcggccagcgccagttcgagcggcgacaggcagccgaaccggaggtaggcgctgagccggctggtgttgtcggcggccatgtcgtcgtggtcctcggcgtaccgcgccatttctttctgccaggcctggagccggcggcggccctcggtctcgccaccggcgacggcgtccggtgagtcgccggcgggcatctcggggagccttcccggcgcgatgccggccggcatcgcgaccttccccggcgttgcggagggtgcgcgccacccagctttctcccaggctttgaagtacggcgtgaacacgcggtacgactcgcctcccccgcccggccggaccgtaccgggcggcagcaccgtgacgctcggcaccgtcttcacccggaatcgctcgtcccgcagccgccgctcgcgccgctgggcgtaaccggtcacgtcggcggccaccgtgatcgtcgacgcgtccacctcggaggcgaccgcgatggtctcggccaccgggtcgccctcccggatcaccaggtcggcgccacgctcgcggagactgttccgcaggtcggccaggctctggtggagaaagcggctgcggttggccgagaggccgctcagccgtgggtcgaggacgaacagcggcaccaccgggtcgggcccgctgagcagcgggttgtcgtggatccgcaggtcgcgggtgaacagcgcgacgcgggcgcccatctcaggccgccagttcgaccggggtgccgggccgggtgagcaggctgcggacggcgaccgcggcccggcgccggttcggcaccgtgacccgccgggcgaacacgtcgtagtcggccgcctcgatctcgtccaggatcccgccgtacagctggaaggcggtccgcatgcaggcctgcgaggtgcgttcgagcagcgggatgccgggggcggcggccgcgtagtgctcacgggcgcggtccacctcggcccggatgagcgcgcggatcgccggggtggcgacgccggcggccaggtcggcgcgggtcacaccgaactcggcgaggtgctcctcgggcaggtagatccggtcccgcgcgaggtcctcggcgacgtcccggatgaagttggtgagctggaaggcgaagccgagctggcgggccggttcgcgggcggcggccgggtcggtggagcccaggatcggcagcatcatggtgccgatcacggcggccgagccctccatgtagtcgagcaggtcgtcgtaggtgcggtagccggtgacggtgaggtccatctccatgctgcgcaggaacttcgcgaagtcctccaggtcgagcccgaagaccgcgatggtgtgcagcacggccgggagcagcgggtcgtcgaccggctcgccgcgcagtccggcgaggaatccggcggaccaggtggccagctcggcggcgcgctcggcgggtggttgcgcctcggtgcggtcgacgatctcgtcggcgaaccgggtgaatccatacagagcgtgcacatgccggcgcttccaggccggtagtaaccgggtcgccaggtagtacgtgcgtccgtgctctcggtgtagctcacggcaccgctcataggcggcggccagatcggtttccatcccggtcctcccggataaatcgacgcacgaatcgacgcaacttctgagagttagggtacggtactggacgtggccaatgacaccctcgagggaaatcgccttgccgcgataccccggcagtccgtctctcacactgggctggtcggtgcagtcgaggggacgctcgccgacttcctcgcctcccagatcgcctctctcgacgccgtcgacccatcgctcggtggcttcggccgcaccgcccgtgacctggtgatggccggcggcaaacggctgcggccgacgttcgcgtactggggctggcgcggcgtcgccgggccggccgcggacgccgagacgctgctgcccgcgctcggcgcgctggagctgatgcacaccttcgcgctcgtccacgacgacgtgatggacgactcgtccacccgccgcggccggcccaccgcccaccggatcttcgcggcccagcacggcggccggttcggcacgtcggccgcgatcctggtcggcgacctctgcctggtctgggccgaccagctgttggcccgcaccccggtgccggcggccaccctgcttgcagtccgcgcgcattacgaccggatgcggatcgaggcggtcgccgggcagtatctggacgtcctcggtgagaccgatccggcgtcctggtcggtggagcgcgcactgctggtcgcccggcacaagaccgccagctacaccgtgcagcggccgctcgacttcggcctggccctggccggggtcgaggacgtggaggtcgccgaggcgtaccggacctacggcatcgccgtcggcgaggccttccagctgcgcgacgacctgctcggtgtctacggcgacccggcggtgaccggcaaaccggtcagcgacgacctgcgcaccggcaaaccgaccgcactgctgatgctggcccgtcggatggccacccccggccagctggccgagctggagtcggcggagatcgagcgcaaggcgcaggtcgtcgccgagaccggcgccccggcccgggtcgaggagatgatccgtgcccgggtcaccgaaggactgaccgcgctggcctcggcgccgatcgacgccgaggcccgtgccaccctgatcgagctggccaccgtggcgacgcagcgcccggcatgatgaaaccccccaccccctggagccgcggcgtgcgcactgttaccggacccaccgatcgtgtcgtgatagtgggggccggcctggccggcctctcctgcgccttgcacctggccgcagccgggcggcaggtcaccgtcgtcgagcgggagccggtgccgggcggccgcgccgggcgcctctcggtcggcggatacgacttcgacaccggcccgaccgtgctgaccatgccggaactgatcgccgagccgctcgccgcggtcggcgagaatctctccgactggctggagctgaccccgctcgacccggcctaccgggcgtactacccggacggctccacgctggacgtccgcaccgacaccacccggatggcggccgagatcgcccaggtctgcggcgcccgcgaggccgacggctacctgcggttcgtcgactacacccggcggctctggcagctggaacgggaccacttcatcgaccggaacctggacagtccgctcgacctgctcaacctcaacctgctgaagctgctcgggatgggcgctttcggtcgcctgcagccgaagatcaacgagttcttccgcgatccgcggacccagcggatcttctcgttccaggcgatgtacgccggtctcgccccgcacgacgcgatggccatctacgcggtgatcgcctacctcgactcggtcgccggggtgtactaccccaagggcggcatgcacgccgtccccaaggcgctggccggcgccgccgagaagcacggggtcaccttccgttacgacacgacggtcgagcgggtgctcacccagcacggccgggcgaccggggtggtgaccgtcggcggggacgtgatcgaggcggacaccgtcgtactcaatcccgacctgcccatcgcgtaccgcgacctgctgcctgcccggaacagccgcaacctgcgcttttcgccctcctgcgtggtactccacatcggatcgtcacagcggtattcgaagatcgcacaccacaacatccactttggtacgacgtggcgccgcaccttcgacgaagtgatcaaccgtgggctgctgatgagcgacccgtcactgctggtcaccaatcccacgcacaccgacccctctgccgcgcccgacggcaaacagacctactacgtgctggcgcccgccccgaacctcgtctccggtccgatgaactggcgcggcggcctcgccgaacggtatgccgacgagctgctgcgtaccctggagcagcgcggctacatcggcttccgggacggggtcgaggtcgaacggatcatcacgccggccgactgggccgacgacgggatggcggccggcacgccgttcgccgccgcgcacaccttcgcccagaccggcccgttccggccggcgaacctgcaccccacgctgccgaacgtggtcttcaccggttcgggcacacaacccggggtcggcgtgccgatggtgctcatctccgggaagctggccgcgagccggatcacacagggagcctcatgagcagcatcggtcacctcaaccgtgaagatcatctcgtcgagctcgtcaacgaggaggggcagccgctcgggtcggccaccgtctccgacgcccacctctcgccgggtgcgctgcaccgggccttctcggtcttcctcaccgacgatgagggccgggtgctgctccagcagcgggccgcggccaaaacccgcttcccgctccgctggggcaacacctgctgcggccaccccgcgcccggcgagccggtcacggtcgccgcggcgcggcgtctcaccgaggaattggcggtacgtgacgtcacgctgaccgagatcggcgtgtacacctaccgcgcgaccgacccggtcaccggccgggtggagcacgaatacgaccacgtgctgatcggcgccctgccggacggcgtcgtgccacaccccgatccggcggagatcgccacgctgcgctgggcctcgctgcccgggctgcgcaccgggttgacggagtcccccgagctgtacgcgccctggctccccggggtgttcgagattctcacggagcggtcgggtgtcctttccacggagcggtcgggtggccggtgaggcgttgagcgccgagatccccacctcgccgggcagctcggtcgcctcctcgcacgacatcccggccacagccggtcccggcgccgtccggaccggcccggtggctgccgcgcccggtggcccgagcgatacgcccctgaccgacgcgacagctgccgcgtcgggtgccgcggacgacgcctcccgggcccgcccggcgaccgccacggacgacgcctcccgcaccggcccggcgaccgccgcgacggattctccggacgacgccgtccggaccggcgtggcagatgccgcgccggccgggcgggcgggcgatgtggcgttgagtgccggggcggccgcgcggcggctgggagtggcggtcacgaccctgcgcacctggcaccagcggtacgggctcgggccgagccggcacgagcccggacatcaccggcggtacaccgccgaggacatggaccggctgcaggtgatgcagcggctcaccactcagggcgtggcgcccgccgaggccgccgcctgggcgcggtccactagctagctagcaggcccctcaccccaccggagcccggcgcggcgctgtacgaccccaccgccgtggcgtcgccacccaccccggccgctcccgggacagccccccggtcggcccccgccggccggggcacccgcccgacccgcggaccggccccgaccgctcgcgggctgacccgggccgcgatgcggctcgacgtgcgcggcatgcgcgacatcctctgcagcacgctgcacgaccgcggcgtgatacccgcctggaccgaggtgatggtcccggctctggccgcgatcggcgaccggtacgaggccactcggcgtttcgtcgaggtcgaacacctgctgtcgcgcgccgtcaccgaaatcctcgcctcggtcccacaccccgccggctctccccgggtgctgctcgccgccgccgacgaggaacagcacacactgcccctggaggccctggccgccgccctggccgagggaggcgtgccgagccgtctgttcggcgcccgggtgccgtcacaggccctgctggacgccatcgcccgcaccggcccggctgccgtcgtgctctggtcgcagcgcccggccaccggcatcgtcacccagctgacccgggtccgcgacatcccgcacccgccgctggtcatcgccgccgccggccccggctggccgcatgacctgccttccgggatcacccgcctgaccggcctcaccgaggccgtccacctgctcgccacggtctagccgcctccgcacgcccctgcccgcacggcccctgcccgcacggcccctgcccgcacgcccctgcccgcacggcccctgcccgcacgcccctgcccgtgcggccctgcccgtgcggccctctccgtgcggccgccttggcgcggcccagcgccttgccgacggccggccggcaacgtttcccctggtcagcgaggtacaggcggaaagagggataccgatttggcggccgctcggtggatcacatatgctttgcaggcctcaacggggcgcggttggggcgaaggccaccaaacgttgctgatcgagcacccagcttgatgtgcaatgatggcggagttgccctcatcgtctagtggcctaggacgccgccctttcaaggcggtagcacgggttcgaatcccgttgggggtactggtaaggttagcgacgcaggtcgctgacagaccagagcaagaaaagcagtgaaatagcaaggtcctgtggagcagttggagtgctcgccgccctgtcaaggcggaggtcgcgggttcaagtcccgtcaggaccgcaaagcaccaagcacggccaggtagctcagttggtacgagcgtccgactgaaaatcggaaggtcggcggttcgaccccgcccctggccaccaggcctctcgccgggcactgagcaccgtccacctgcggaaacgcatggtggacgttttgctttccgggcctccccgacgtctgcttccggcttctcaccggcgttttgtttcttgctcctccccgacattcgcttccccgctcgtcccgacgggcgccgccgccggggtcgcgtaacagatgttcccggccgtcccgggatctggtcggcagttgagcgtgtgaagcgcccggcggaggcgccgggcgcttctgctttgcgcgagcgcccccgcggctcgtcccgccatcgtatgaacgatcggtttcgcggttgctccctgattcgtgccactcgccgccgagcggccgggagcaaaccgggttgccttggacgatggtgccggtcggcgcccggagaaacgccgggacgtggccaccggacgggggctcggggcggcggcggatcggcggtccagggtggagcggtgaaggtctactcgggaacgcgccgtcgggccggttgtccacagggcggggaaagcctcttgtagcggacggctccgctgactaagagtgttagcggtatcggtccggttggcgaggaggcacagcgacgtgcagagcttcacgaacgaggccgagcagacggcttacaacctggccgaggctctggcggaaaaggcgatgaccttcatgagaaacgcggaggaggcggccgagacgttccggcgcgggcggattgcgatgcgccggcagttcatggcgcgcgggttgtccgaggcggaggcggacatcaggttcgccggcaccacgcaggcgtcccgggcgatcgcggacaacaccttcttcatgtcgcaggcgtcgatgtacaacacggccgccgcgacgcagtacgcgaaggcgttgtatctgaagaagcagtgaccgctcaggccgcccggtgacgcagtgtcgcgaccgtggagccggccagggcgagcaggcagtcgggcagctggccgtcggcgatcgcggcgccgaagagggcttcgccggtgttggcgtccccgttgacgtaggcgctgacgaaacgggcgacccaacgcttatcgtatcgggcatcgtcgataccagggaattccagggtccaggcgccgatgccgggtagctggccgaccatggtggcggccaggcaccacgcgacgtcccacgcgccgacgacgccgtcccggctgacgacggcgttgaaggtgctggccacggcatcgctgtcaccgctgagcgcggaggtcaggatctgcgtggcgtcgtcgaacgcgtgctgtggtgcttcggtcacgttccaaaccgtacgcgtaatcgtcaagccacgctcggcggcgaacgactccgggaaagcggtccggccgcccgcctccgggcggccgcggatcggccgccgggcgagagggccgcgaaacagccaggtcatgggcggtgccgagtcggacgcggaagccggtcaggtgaccgaggcggtgcgagtcaggcgccgcgcagcaggcacgtgatgcgggcggtgcagacccgctcgccggcctcgtcctccagaaccacctcgtaggtggccacggcgcgacctcggtgcaccggcaccgcgacgccggtcaccaggccggagcgggccgccttgtggtgggtggcgttgatgtcgacgccgaccgcgaacggccgatcgaccgtctgcccgtgcaggaccgcgccgaccgacccgagggtctcggcgagcacgcaggacgctccgccgtgcagcagaccgtacggctgggtgttgccctcgaccggcatcgtgccgaccacccgctccgccgtggcctcggtgatcacgatgcccatccgctcggcaagcgcaccgcctccgttgctggtgaagaggtgctgcatgccgtcttccgcgatatccacgacggcgtacgttacccccggccggatcgggcaccagcgacacgtgtcacaacgatcggactgcggtttgcgtccaccgggtactcatgtggcggttgtgccgcgtgatccatccgggcagagtcggggtccgtaccgactgacagatcctggaattccgcaagaggagacgagatgagcgagccgcaggagatcgtcgagacccggggcgacgaccgcgtcgacctgatcaccagcgacgccaaccacgacgggaaggtggacgtctgggtgtcggacaccgacggcgacggcaagccggacctgttccagttcgacaccgacggcgacggcaaggtcgacgtgacgatggtcgacctggacgaggacggcacgccggacacgatcgtcgacggggacggcggcctgcccccggccggcaccgtctgagcatcgcccggacagcgggtcaggcgccgccgagggcggacagggcaacccacagcacggcgatcgccaccgctgcggtgcccaccgtcgaggcggtgtgccgccacgtgcgtaccccctcgaccgcctccgggtgccccagagcctgcagggtggcgcgatggtggcgtacctcgccatggtggtgatctgtctgcggcagcggttgggacgtccggctgagctcgacggccagccgggctagctagctagcgggccccggaaccgagcgcgtgcaactcggcctcggtgatcacctcggggtcgccgagcccggcgagccgggcgacgtaatactccgcctcgcggtcgtgcgcccggcggaccaggaacaggatcagcagcagcggcggcaggcctttgaaggtgagcacggcgagcaacgccaccgcgccgttgccgagcccgtcgcggaacagcggcgagttccacagcacgtgtgacgcccacgcgccgaacagggccaggccggccatcgtgagccggcgcgaccggctgcggtcggtgtgcaccaccagatagccgatgccggcgccggccagcgcgccgaacagggtgtgactccagaccccggccaggaatccacggaccaggaacgtggtgatcaccggccgcacctcgtcgccctgcccggccagcgcgaccgccccgatcgcgaagacgatgtcctcgacgatctggaagccgagcccgaccagcgcgccgtagacgacgccgtccagcacgctgttcacctgggagcgggcgatcagcacgatggccaccacgccgagcgtcttggcgatctcctcgaccgtggggccggccagggcggcgccccagtcggcggccaggccgggtgagccgagtttggcgatcaggttctccagggcggtgctgcccgggatggagacgctggtggcgaccacaccgccccaggcgaacgcgacggcgagcagcccggccggttcccgttccaggaagtcgagctcctggacgaacatccagaacgggacggcgagcagggcgaacaggccgagcgcggtgatcgtggcgatcgggtagaggtgcaggaaccgggccaggagttgcgacatccgcaccgcgccggcggcgagcagggtgatcaccacccagaacgcgggcacccggacgagggtgtcgagccgggtgtcgccgggccgcaccggttcactcatcggtcacccctcgtatcgcacggtccgggtgctggcgtcgatggccggcagcgtgtggtccaggtcgaggtcggcgccgctgacggtgacctcgatggtcaggccgtgcacgacgaagacggcgtaccggccgccgcggtcgccggcggtgtatccgccctgcagaccggccagcccaccggcggtggagacggcgagctgggtgccggtgatctggtagccggcggtgccggtgatccgctgccggagtcggacggcggcctgggtgaggttgccggagaagggttgtacggcgatcgcgtaccgcaccgggccgagccggaacagcgcggtgccctggtcctcgcccggccgggtcccggtgacgtccagggtggcgccggtcgggggcaccacggtgaccccggcaccgacccggtacggctgaccggccggcacggcccgctgggccgagacggcgtggtcgagtgccggcaggccgaaggcgagcgccgccaggagggcgaccagaacgatcgcgccgagcagtccgggtgtgctggggagatcggtgagatgacgccgcgtgaccgtccccattcgtccacgctatcggcgcaggcgcggtgatgtccggtgatcctggccggtcgccacagtggacggacgatcaacctggcagattacggatttgtccgttttagcgaaaggtgcactgggggcacgacggaggtcaaccagaccccgttctcgctgcggtggaagacgtgccccgcggcggccatcaccccggcggccacctcgaagaccaccacgtcgggcgaccggcgccggcccaccaccagggcggtcggcacgtccgccgacaggtgcacgtggtgccgggtgcgcgggcgcagcccgtcccgcaggatcgcgtcgaggttggcccgcggcgtgccgtggaacagcgtcgcgggcgggatggccggcggcaggtccaggtcgacctcgacccggcgggaatgaccctggctggcccggatccgctccaccccgtcggggccggcggcgaccgcgaaccgggacttgtcgttgaaggcgaccacgtggtcgagctcggcgcggctgatccccagcgcggcgaggaagtcggcgaccggcacccagccctgcgggtccagcgtcagcccggccgtctccggccggtgccgcagcaccagggacatccggcgactgagacgcacctggtcacgggtgagttcggtcaatgattctgctccatgaccgcaaggtagtacgggtggtcctgccggtcgaccgatttcagatgccatccggtgccctgcagcagcgcgtcgagctcgtcaacggagcagttcagatagtcgaaccagtcggtggccaccagccggtagcgcagccgcagccgcaactgcccgccgagccgcccgcgctcccggttccgccggtggtagctgacgtgcaccggatccttggtgccgtacgggtcggcgccctgcgcgatgatccgcgcacccgggttcgccaggcgggacagcgccgccaggaaggccggcgcccgctcgggcccctcgatcaggcccaggttgttgccgagcagcaggaaggtgtcgtatcgcgcggtggccgtggcgtagcggtccacggtgctcagcacggtgtcgcgcagcccccgcttgcgggccaccgcgatcgccccgggcgaggtgtccagcccggtcaccgccatgccgcggcgctgcagttcgagcgcgatccgggcggcgcccaccccgatgtccagcacgtgcccgcggcacaggcgcagggcccggtggtcgtgcggttgccaggcgtccggctcgtccaggtagtggtcggccggggcaccgttgatcaggccgtcgtcccgctcgatcacctcgatcaccgggcggggcaggcggccaccggccagggggcgggggccgatgccggttcgcaccgcgtacgcgtctgtgatcatctcgccgaaggcgtcgccgatcgtcggctgctccatggctcactactcttgttgccgcgcccgccggggggcaactcggcccccccgcgtaacccagcccggcctagatcgttgatctagccgaggacgaacgagaaaacgaagaaggggcgatacgccttccccagcgcacgccccttacaacgatctaggtcgaaccggtcagtcaccctgccgctgcgtgggaatctgcccctgcagcagggcgcgaacctccgactcccggtagcgacggtggccgccgagcgtgcgaatagcgctgagcttgcccgccttcgcccaccgggtgacggtcttcgggtcgacacggaacatcgacgccacctcggccggcgttagtagcggctcaggatcgtgcgtacgcgatgccatcggtcactcctccacaggtgcctaaaaacatcggccggggtcccgccggccggtgcgtctctcatggtccggctagtccccgatgtccgacatgggccgaacggacgaacgtccccagatagacggatgaagcatgcccgatttttgcgtgttttctacgccagatagtgtctcgtttagtccgattatcacgcttcgggggtcgccgattacgaagagtgttcgcttcgggagcgctctcatcggcggggaaacttcccgatctgtcctatttccccaggtcagttgcaccgctccagaagttggacacttcgccatctagcgaccagcttctcgtacgcctcgccagccgcgtcggcgtcgccctgggacagggcggacagcccggccgccaccagtccgggggaatcgtcaccggtcagcttgtcctccggaaggaggttgaccaggccgccgtagtccagctcgaccaccgaccgggggtggaactcctccaaccaccgggtgccctcctcgaccgcctcggtgatcggggcgtcgccgagcgacttacgcagcaccgacaccgcccgatgcgcgcgccggcgagccttggagatctcggtccggtaacgcagggtgcgccgccggccggtcagggcgatctcccgctcctccaggtcgacgaaggcgaaccagcgcagtgggaccccccaggtggcgatctgctcgtgcacccgaggaacgccctgctccagcacccgggcgccgctgcgccagtcctccaccaccgccttggcctggccggccagcaccggggggacgaacgcgtcggccagcaccgccggaacgccgtcgcgggcgctcagtgccgcctcggcgacccgcagccgcaggttccacgggcagatcagcagagcgttctcccactccaggacatacgcctcgtcgggcaggtcgggcagccgggtccacccggcgccgagcgcctccaggacggcggtgcgctgccggaccgggccctcgatcggccccaggtcgcgaccctccttggcgtagcggcgccagaagacctgccgctcccggtcgaaggcggtcagtggctcgtaaacccgtaggtacgacgcgaacagtgacggcacggcgcgatcctttcacgaatttgcccgggtggaacttcccgcgcgggcgtaatcaccgtgccgttctcgcgattaggctcgccatgtccggcctaccccgccgggtgacgggccccacgaaggcccaccgacgaatcaggagaacaacgatgggtgtgttcgacaccgacggcaccgacgccagcgggcacgaacaggtcgtcttctgccaggaccgggtctccggcctgaaggcgatcatcgggatctactcgacggccctcgggccggcgctcggcggcacacggttctacccgtacgagagcgaggaggccgccctcgccgacgtgctgcggctgtcccgcggcatggcgtacaagaacgcgctggccggcctggacctgggtggcggtaaagcggtcatctggggcgacccggccacggtcaagtccgaggcgctgctgcgtgcctacggccgcttcgtcgagtccctgcgcggccgctactacaccgcctgcgacgtcggcacgtacgtgccggacatggacgtgatcgcccgcgaaacccggtacgtcaccggccgcagcgtcgagcacggcggcgccggcgactcctcggtcctcaccgcctggggcgtcttccagggcatgcgggccgccgccgagcacacctggggcagccccacgctcgccggccgcacggtcggcgtggccggcctcggcaaggtcggcaagtatctggtcggccacctggtcgccgacggcgccaccgtggtggccaccgacgtgaacgaggcggccctgcagtgggcccgcaccacccaccccgaggttcacctggtcccggacaaccagacgctgatcacttcggatctcgacgtctacgccccctgcgcgctgggcggcgccctcaacgacgacacggtcccgctgctgcgcgcccgggtggtcaccggcgcggccaacaaccagctggcccaccccggcatcggcaagctgctcgacgaccgcggcatcctctacaccccggactacgtggtgaacgcgggcggcgtgatccaggtggccgacgagatcgagggcttcaacttcgagcgggccaagctgcgggcgaccgggatcttcgagaccacccggcggatcctgcagctggccgacgacgagggggtgccgcccgcggtggcggcggaccgcctcgccgagcggcggatggccgatgtcggccggctgcgctccatccacctcggctagaccggttcagtaccgccgcgcgacgcctgaaatgggcgccgcgcggcggttcggggccttccggcgggctctccggaagaagaaccgcgacgcgcggcagtgtcacacgcaacccgaggtgccgaagacggcatcgtccatgtaccgtaagacccacgagagatgcctgacgtcatcggggcccgccttcgggctgccccgaattctgtgcgagggggtcgagccatggggcgcggccgtgctaaggccaagcagacgaaggtggcccgggagttgaagtaccactccccgaacaccgacctcaccgccttgcagcgcgaactggccggtagtacacgccagtccgatcatcatttcgacgacgacaatgaagagttcgtcgatgatgacgaggatgacgctgacgacgaccaggattcctggtcgcctccaaggcgtatttgacccgtattgcacagagcacgcggtgtgacccgcgtgctcacgtgcgccgtggtcatcaactcctgacggctacagggaaaagcccacgcgggcggtgtccgcgtgggctttgaccgagcagcgtttcaccgcggccggttgttccagttgtagaacgtgggaatgttctcgaagtggttccaggcgcacaccgccgagccgctttcgggagtcgcctcctcggcacgttgccggcgggccgtctcggcctccgcgatgagcgcggccaggccggcccgggtgtcatgcacccgtgccgtcaccggatccgtctccacggcgtcagacggccgtgggctcgtgatctcgggcatggtccagcactccctccaataggcgaatcttgctgttccggcagtggttcgtctcggtgacgtcgaatctgccgtgttcgaagtagcggttcgccgcgtgcgcgccgccgcagaaaccgaaatacgggcagctctgccggcacgcctccacgccctgcaggaactcgccgatccacggtgtccgcccggcgtccgcgaggatctgccgcagcggggtggtcagcacgttgccactggtgaaatcgccgtagcgcgggtcgtggaacccggccagttcgggcgagagcagcaccaccgagccgtcgtgggcgatcgtcgggatcgggtcgagccggcggggcagcagccggtcagccgtgccgtcgagcacggcggccacatagcgcagcgaccactccacctcgcgcagatggatccgcggctcccggcgccaggcgccgaccagctccgcccagaacgcgctgaccgcggccgggtcgtggctgttctgccggaggttgacgccctcctgctcctccacgttgatgccgagcacctcgcagcccaggccgagaaaatactcgtacagctcggtggcgacgcccgggcgcggatcggccaccacgcacagcgcggagaacgggatgccgtgccggcgcagcgccgcgatccccttggcgatcaggtcgtacgccggtttcccggcccggtccacccggtcaccgttacggtccggcggcccgtcgacgctgacgctcacccgcacgtcgtgagccttgaagaactcgcaccaggcgtcgtcgatcagcgtggcgttggtctggatgtggtgctccacatccggtccgaacggcgcgaacagggccgccaggtgggccgctcccgcggtcagcggctcaccgccgtgccagaccaccgagaaccggccggcccgggcgaagccggcgacctcggccgccaccgcctcggcgacggcgaccggcatcttccggttctcccggcggaacggcagatagcagtaattgcaggccaggttgcacagagtagtcggctgcatgaccacatagccgggttccggcgagatgccccgcatcccgctccacgcgtccgccatcgcgcacctccatcctgcccctaaagacacagggccaggctaggcctcgcggtccaatgaacatgcgaaagatccgtatgtgccggacatcggcacacacggatcatttcatggcacacctataacgaaccagactcacgtctcagcggtcaccgttacagagcgtcagccccgggtgtaggagcccatcatctgcacctgcccggtgccctccagcacctcgccgacctgccaggcctcgacaccgcgaccggccagataggccatcgcgcggtccgcgtcgtcggccgagacgaccgcgaacatgccgacacccatgttgaaggtggcctccatctccgagtcctcgatccggcccttggcctggatcaggtcgaagatcggctgcgggcgccaggtggaccggtccaccacggcgtccacgtgctcgggcaggacccggaccaggttgccggggatgccgccgccggtcacgtgcgagaacgcccggacgtcggtctcctcgatcaggcccaggcagtccttggcgtagatcttggtcggggtgagcagctcctcgcccagcgtgcgcgaggtgccgaagtcgtcgaccacggtgtccaggcgcatccggccggcgcccagcagcacgtgccggaccagcgagtaaccgttcgagtgcaggccggacgagcgcatcgcgatcaccgcgtcgcccacctcgacccgctccttgccgaggatctcgctctcctcgaccacgccgacaccggtcgccgagacgtcgtactcgtcggggcgcagcacacccgggtgctcggcggtctcgccaccgagcagggcgcaccccgcgtagcggcagccgtcggcgataccggcgccgatctcggcgatcttgtccggcacgacctcgccgcaggcgatgtagtcgagcaggaacagcggctcggcgccacaggccaccaggtcgtcgacgaccatggcgaccaggtcgatgccgatcgtgtcgtggatgtccagctgctgcgcgatgaccagcttggtgccgacgccgtcggtggacgaggccaggatcgggctcttgtacttcgccgtgttcagccggaacaggccggagaagcctcccaggtcacccatcacctcgggccgggtggtcttcttcaccttggacttgagcagctcgacggcacggtcaccggcgtggatcgagacgcccgcgtccgcgtaggtcgcggcgcgcttgcgcgggccccggccggcgccggcggtccacagctgtcggtcgccctcggatccggcattgcgctcggacacgtgcgtcacggttctccccttagcggtttcttcagaaactggaaaagtcacgggtggtgcagcgccgtggcgccgcccgggctggccaccagcggcgccggtgccgggtggtcgtcctggtgctcgcgggcctcgtagtcggtctcgagctcggcgaccgcctccgcccggcggctcaccccctccagcacgtgcttgccgatcagatcggcggccggcagctcgatcgggtactccccgtcgaagcaggccatgcagagccgggatttcggctgctcagtggactggaccaggccgtccagcgagacgtagcccaggctgtcggcgccgatcgagcgccggatcccgtcgatctccagaccgttcgcgatcagctcggcacgggtggcgaagtcgatgccgtagaagcacggccacttcaccggcggcgacgagatccggacgtgcacctccagggcgccggcctcgcgcagcatgcggatctgggcgcgctgggtgttgccccgcacgatcgagtcgtcgaccaccacgatccgcttgccccggaccacctcgcgcagcgggttcagcttcagccggatgcccagctgacggatcgtctgcgagggctggatgaaggtgcggccgacatacgcgttcttcatgaagccggcgctgtacgggatgccggacgcctcggcgtagccgatcgccgccgggatgcccgactccggcacaccgatcaccaggtcggcctcggccggatgctccttggccagcttgcggcccacctcgacgcgcgcggcgtagatgttgcgaccggcgatcgtggtgtccgggcgggcgagatacacgtactcgaagaggcagcccttgggctccggcgcggcgaaccgggtggagcgcaggccgtgctcgtcgatcgccaggatctcgccgggctcgacctcgcggacgaagctggcgccggtgatgtccagggcggcggtctcgctggcgaccacccagccgttctccatccggcccaggaccagcgggcgtacgccctgggcgtcccgggcggcgtacagcgtgtgctcgtccatgaacacgaagctgaacgccccgcgcagggtgggcagcacctccatggcggcggcctcgaccgacaggtccggccggccggccagcagcgtggtgaccagcatggtgtccgaggtggcgtcaccgacctcgaggccgcggtcggcgacctccttggccagctcggcggtgttcaccaggttgccgttgtgggccagcgcgatggtggtgccggccgtcgtggcccggatcgtgggctgcgcgttctcccaggtgttgccaccggtggtggaatagcgcgcgtggccgatcgcgaggtggccgcgaaggctggccagcgtcggctcgtcgaagacctgggagaccaggccgacgtccttgtagaccacgaccccggagccgtcgctcaccgcgatgccggcggcctcctggccccggtgctgtagagcgtagagcccgaagtacgtgagtttggcgacctcttcctcgggggcccagacaccgaagacaccacaggcgtcctgggggccgcgttcctgggggtcgagatcgtcggtcaatcggccgtcgcctcggggcacctgctcgctccctcatgtcggatccgccacgaactgctcgaagcgctgaccatcgctggtctgcccgaactccgctcgctccgatcgcccagtgtacgcgagcccccgggactcggccccgggctcattccggggtcagcggcaggaactcgctgagatcggtgcggattccgctggcccgcaggcgtccgtcggcgaccgcttccgcccatgccaggcgtccggtggccaccagcagccaggtgaccggatccgtctcgaccacattgggcggtgtgccgcgggtgtggcgcgggccgggcacgcactgaatagcgccgaaaggtggaattcgcacctccaccgatcggccaggcgcgcgtccggacaactcggtcagcagtgctcggaccgcgtcacgcaggaccgttcggtcaggctgggtcccggcgtccagcgcgtccaacgccttggacaccgagtcggaattattgtgcgcaggcgacatgtcgggacgatacgacgcggttcaccgagaacggcacacgcccctgggtcgcgcaaaaggcgtgtgacaaggcatagttgccgacggcgtacaagtcgcgggagatctgacgggcaagtaaccggcggagcacgcgacacggaaggtggtggatgtgacaacgcacctacgaggccgggctgcccgggccggtgcgttcctggcactggtcgtgggcttgatggccggcgtgcagacggcggctctggcagccccgggcgacgccagtggcaacctcaccgtccaggggcaggccaactccggggaaagtgtaaccgttcagtacacggttagtaaccccggtaccggagcggtcaagttcaccgtcaaggctgccggtgccgactgcgcgccgtgccccaccgacaacgtcagcgccggcggcggaacgtcgaacacggcgaagctccagatgccgactgtcgcggcgggccagaccgcctcggtctcggtgacgctgaccgcagacgacggcaccggcccgaagacgatcgacggcccgaagaccatcacggtcaacggaccggccgcgccgaccaccacccggcaggtcgcgggcaagatcaaggacagcaccggcgccggactcgcgggcgccaacgtcggtctccaggacagcaagggtcaccagtaccagaccaccagcaacggtgacggcggcttctccttcacctcctcggacgccgcaccgatcgcgaccggctcgatcctgatcggcgccaagatgaagggttacaccggcgcgagcgcccgggtgaccggtactgccggcaaaagcgtctccgtcagcatcacgttgaagtcggcgaccgccgcctcggcgtcgccgaccgccaacgcgagcgccgcggccagccttccggccgatgacgccggcaccgacgacgcgaccaccgacgcggtcaccaacgcggccggcaccccggccgccgacgcctcgaagacctcgcacgacagcggcggcagctcctggctgctgatcgtgatgggcggcctgctggtcgccgcgggcgtcggcgcgatggtgctggtctggctgcgccgcaagaacgcggccaaggacgacggctcggacaccggcgtcggcctcggcggctcgggcggcaactagctagctagggcggcggccgcggcgccgacgcgaccatggtcgccggcgccgggatgggcgccggtcagggcatgggcggcggcggtctgggcgacgcgcccacgatgatccaccggccgccggtcgaggacgagttccccgacccgtacggcgcgccgatgcctccgcagggcggcttcgtcggctcgaacaacagccagtgggacaaccaggccggcggcggcaactacggcggcggcacggccgcggccggagccggagccggtggcaactacggcggcggcacggccgcggccggagccggtggcaactacggcggcgccaccagcgtgtacggcgcgcagcagggcggctacgacgacgccccgcagcagcgctacgacgagcggaccgggatgtatcagccggacaacggcgggtacgaggaccagggcggctacggcgtgcagggtggctgggacaaccacgccgacaacggcggcgggtacggccagcagccgcaggccggcggcacctacggcggcggcacctacggccagcagcagggcggctacgaccagggcggtcagcagcaggccgggtacgaccagggcggctacggccagccgggtggttacgaccagggtggctacggccagcagccgggcggcggctacgaccagggcggctacggccaggaacagcacgaccagggcagctacggccagcagcagggttacggccagcagcagggcggcaactacggcggccatcagggcggctacgagcagcagccgaccagcggctacggccagccgcagggccagcagccgcagggccagcgcggcggcacgtacggccagcaggacccgaaccgccgcaaccgcgagtgggacgagtgatctgaaccgaaacgaagaatggccccgcgcgatgcgcggggccattcttgtcggtcctacagcggcccgcccggcttcggctcggtcagctccagcgtcaccgaccggccctcggcggccggctcagccccgccgaacagcttcggcagcgtgcccgaccaggccgcccgcagctcgtccagcggaatcgtgaactgtccggtcacctccagggccgcggcctcggtggtggtgccgatcttggcgcacgggacgcccagctcggcggcgagcgccacgaaagccttctcgtggccctgcggcacggacaccaggacgcgcgcggccgactcgctgaacagcccgacgaaggcggactcgacggtcaccgacgcaccggtgccgtagcgcaggcagctctccaccaggacctgggccaggccgccgtcggagaggtcgtgcgccgcgctgaccagcccggtctgcgagacgcgggccatcagcctgcccagggtctgctcggccgccaggtcgaccttgggcggacgcccgccgaggtggccgtgggtcacccaggcccactcggagccggacagctcctcgcgggtctcgccgagcaggaagagcagctcgccggcggccttgaagcccatcgggacgcgccgggtgacgtcgtcgaacaggcccatcacaccgaccaccggggtggggtggatcgccgcggcgccggtctggttgtagaagctgacgttgccgccggtcaccggggtgcccagctgctggcagccgtccgccaggccctgcacggcccgggcgaactgccacatgaccgccgggtcctcgggcgagccgaagttcaggcagtcggtgaccgcgatcggctcggccccggtgaccgcgacgttccggtacgcctcggcgagtgcgagcttggcgccctcgtacgggtcgaggcgggcgaaccggccgttgccgtcgaccgacagcgccacgccgaggttggtctgctcgtcgagccgcagcacgcccgagtcctccggctgggccagcacggtgttgcccagcacgtaccggtcgtactgctcggtgacccaggtcttgtcgcacaggttcggcgaggcggccatccgcagcacggtttcgcgcagctcggcgccggtggtgggccggggcagcgtctcggcccggtccgcctgcagcaggatcaggtcggacggctcgcgcagcggccgctcgtagatcgggccgtcgtcggcgagcgaccccgggggcacgtccaccacgacgtggtcgttccacgtgatgtgcagccggcccggggtgccgtcctcggcgcgcggggtgacctcgccgatcgcggtggcccagacgccccacttctcggcgaccttgaggaccgcgtcgaggttctccggggtgacgatcaggagcatccgctcctgcgactcgctggccaggatctcggtcggcgacatcgaggcctcgcgcagcgggacccgttccagccagacccgcatgccggtgccggcggccgccgcggtctcggtgagcgcgcaggtcaggccggcgccgccgaggtcctggatgccggtgaccaggccggcgtcgtacagctccaggcagctctcgatcagcagtttctccatgaacgggtcgccgacctggaccgacgggcggcgctgctcggcctcctcgtcgaaggtggcggacgccagcacggagaccccgccgatgccgtcgcgaccggtccgggcgcccagcagcacgacgatgttgccggtgccggtcgcctccttcttctgcagccgctcgaccggcagcacgccgatggagagcgcgttgaccagcgggttgccctggtaacacgggtcgaagacgatctcgccgccgatgttcggcaggcccaggcagttgccgtagccaccgatgccggccaccacgccgggcagcacgcgggcggtgtccgggtggtcgtgggcgccgaagcgcagcgggtccatcaccgcgatcgggcgggcgcccatcgccaggatgtcacgcacgatgccgccgaccccggtggccgcgccctggtagggctcgacgtagctggggtggttgtgcgactcgaccttgaaggtgaccgccaggtcgtcggagacctgcacgacgccggcgttctcgccgatgccggccagcatccgggtgttcttcgggaccttggcgacgaactcgcgcaggtgcaccttgctcgacttgtacgagcagtgctcactccacatgatcgagtacatcgccagctcggacgcggtggggcgccggccgaggatgtccttgatcttcgcgtactcgtcgtccttgagcccgagctcggcgtacggctgcaggtcgtcggaggtctgctcggccttctgcacggtgtccgggccgtcggcgaagccctcggccaggacgtcggtggcggcgaagccggtcttgtcctgcgtggtcactgctgtcccccttgcgagccgcccgcggacgaacccgccagggcccgcaggacggaggtgaagaagccgaggccgtccagcgacgggccggtcagcgcctccacggcgtgttccgggtgcggcatgatgccgacgacattgccggcctcgttggtgatcccggcgatgtcgcgctgcgaaccgttcgggttgccgttgatgtaccgcgcgatcacccgcccctcggcctcgagcctgtcgagggtggccgggtcggcgacgaagcagccctcgccgttcttgaccgggatgaggatctcctggcccggccggaagccgttggtccaggcggtgttcgtggcctcgaccttgagccactggtcccggttgcggaagtgcaggtgctggttgcgggtcaacgcgccgggcagcaggtgcgcctcgcacaggacctggaaaccgttgcagatgcccagcacgggcaggccgccgcgggccgcgtcgatgatcgactccatgaccggagcgaatcgcgcgatggcgccgcagcgcagatagtcgccgtaggaaaagccgccgggcaggaccacggcgtccaccccgtgcagatccgggtccccgtgccagaggcggacggcctcggcgccggcgatccgggcggcgcgggcggcgtccccgtcgtccagtgatccagggaaggtgaccacaccgatccgcatggtcaggcgacctccgccgcgctctcgacccggaccgtgtagtcctcgatcaccgggttggcgagcagcttgtcggcgatctcacgggcccgatccaggtcgggttcgccatcgaattcgatctcgatccgacggccgatgcggacagaggagacatcggtgacgccgagccgcggcagcgcattcgctaccgcctgaccctgcggatccaggatctccggcttgagcatgacgtcgaccacgacgcgagccacgggcactcctgactgataggtgtaagcacggaggagcctacctggtcaactgttcacccagttcaaaggatgggcgcgggggcgtagccggccgccgcggggtgatgctcgacgatcgcggcgacccggtcggccaccgcgcgcacctgagccggcgcggcgcccacgaacgccgcccggtcggcgaccagggtgtcgatctcggcacgggacagctgcagccggccgtcgtcggcgagccggtcgaagaggtcgttgaccgccacgcccttctcccgcatggccagcgccacgccgaccgcgtgctccttgatcacctcgtgcgcgacctcccggccgacccccttgcgcaccgaggcgaccagcagcttggtggtggtcaggaacggcaggaaccggtccagctcgcgggcgatcaccgcggggtacgccccgaactcgtcgaggaccgtgaggaacgtctggaacaggccgtcggtggcgaagaacgcgtccggcagggcgacccggcggaccaccgagcaggagacgtcgccctcgttccactggtcgccggccagctcgccgaccatcgacaggtaaccgcggacgatcacggcgaggccgttgacccgctccgacgagcgggtgttcatcttgtgcggcatcgccgacgagccgacctggcccggtttgaagccctcggtgaccagctcctggccgaccatcaggcggatcgtggtggccagtgaggacggcccggccacgatctgggccagcgcggagaccacgtcgaagtcgagcgagcgcgggtagacctggccgacgctgctgagcacccgggtgaagccgaggtgctcggcgaccttggcctcgagctgttcgaagtcggcatacgacccgtcgagcaggtcgagctggtcggcggcggtgccgaccgggcccttgatgccgcgcagcggataacgacccagaagatcttccaggcgttcgtacgcgatgagcagctcctcggtcgccgaggcgaagcgcttgcccagcgtggtggcctgcgccgcgacgttgtgcgagcggccggtgatcaccaggtcggaatgctcgacggcgagcgcggcgaggcgggccagggcggccaccacccggtcccggatcagctccagcgaggcccggatctgcagctgctcgacgttctcggtgaggtcgcgggaggtcattcccttgtggatctgctcgaagccggcgagctcggagaactcctcgatgcgcgccttcacgtcgtgccgggtgacccgctcgcgggccgcgatcgaggccaggtcgacctggtcgagcaccgactcgtaggcctcgacggcgccgtcgggcaccgcgacgcccaggtcacgctgtgccttcaggacggccagccagagccggcgctccatccggatcttctcctccggcgaccagagggtgacgagttcggcggaggcgtagcggctggcaagcacgttcgggatggtcacggcaccgattctcccatctcatcgggcgggcccggctggggctccagctcgatcaccgcgacggcccggatcgcgcccggggtgcccggcgggacagccgcgtcgcgcaggtgccggacggcctcggcgatgcggtcccgcgcggcacgccaggccgcggggtcgacccagacgtccgtggtgagccgctgcgccgccgtgcaccggtatcgcttggccaggccgccgcggatcttctcctcgccggcggccgcgatcaggccgccggcggacaggtggcgcaggtggtagctggcgttggcgtgggtgatgccgagcgcgcgggcgacgtcggcggcggtcagttcggcaccggtgagcagcgacatgatgcgcaaccgcaccggatgggcgagcgcacgcagcgaagcatcccccaaagacatggtggacagcctaggagacggcccggttgaccgtccaacatttgtttgagagtggcagactgcacgaaaaggcggcattctcgctaaggttactggcgagtaggttcgacgttcattccgaaaggtccactgatgactgaattcaaccccgagtcgctctcctcgatcggcccgaaggagttcgctcagctggtcaagtccaccccggatgccaggctcggcgaggtcatggcgtcggacgcgcgcggcaagatcctcgacgaggtcttcaaccggatgcccacgctgttccgcgcggagaaggccggcgacgcccaggccgtcatccactggatcatcaccgggccgaacggcctctccaacccgtacgagaccgtgatcgagaacggtcagtgcacggtcacgaacgagccggtccgcgacccgaagctggccatgaccatggacgccgtgacgttcctcaaggtcgtggcgggcgacggcaacccgatgatgctgttcatgaccggcaagatcaaggcgaagggcgacctgtcgctggccgccaacatcgccaagctgttcgacatccccaagggctgatcaacccccagaaccctgattgctgagtacgtcgtgagcacccacgccgcggctcaacggcgccgcagaggcacggcggccgtgctcacgacgtacaccagccagggtctagatcttgatctggccgttgagcgcgcgcagcgcgatgtcggtgcggaactgggcgccgtccagcgcgacgccgtcgaccagggcatacgccgcctcgcgggcggccgcgaggtcgaccccggtggccgtcacgctgagcacccggccaccggccgagacaaggtcaccatcggcgttgcgggccgtgccggcgtggatcacgccggggacctcggcgccggtgatcacatcgccggtgcgcggcgtgccggggtagttgtggctcgccacgacgaccgtgatcgccgcgccgtcgtgccaggtcagcggcgggtgctcggccagcgtgccggtggcggcggcggtcagcagaccggccagcggggtggccagcagggccagcaccacctgcgtctccgggtcgccgaagcgcgcgttgaattcgatgaccttggggccgtccggggtgagcgcgaggcccacgtagagcagtccggcgaacggcgtgccgcgccggcgcatctcggcgagggtcggctcgaccgtctcccgcaggacacgctcggtgaggtcggccggggcccagtcgaggggcgcgtaggcacccatgccaccggtgttcgggccctcgtcgtcgttgagcaggcgcttgaagtcctgcgccggcatcagcggagcgaccgcggtgccgtcggtgatgacgaagagtgacacctcgggaccggggaggaactcctcgatgaccaccttgccgcactccgcggcgtgccgctcggcggcctcgcggtcgtcggtgacgacgacgcccttgccggcggccagaccatcatttttcacgacataaggggcaccgaacgtgtccagcgccgcgctcacctcggcggccgactcgcaggctgccgagcgcgcggtcggcaccccggccgccgccatcacctcgttggcgaacgccttcgaaccctccagccgcgcggcggcggcggacgggccgaaacaggcgatgcccttggcgcggaccgcgtcggcgaccccggagaccagcggcgcctccggcccgatcaccaccaggtcggcgctcagctcggtggcgagcgccgcgaccgcggccggatcggtagcggtcaccggatggatctcggcgacctgggcgatgccggggttgcccggcgcggcggccaggaactcgacggacgggtcggcggccaggccgatggcgagcgcgtgctcgcgcccaccggagccgatcagaagtacgcgcacgacggccaatcctacgtccagtaaacttcggcagtacccgggctcctccgaggtacgaccttcgggaagggcatacctccagtgccggtgatcgtgttggtcggcgcccagtggggcgacgagggcaagggcaaagccacggacctgctgggcgaccggctcgactacgtggtgaagttcaacggcggtaacaacgcgggccacaccgtcgtcatcgacggcgagaagtacgcgctgcacctgctcccgagcgggatcctctccccgaacgtcgtgccggtgatcggtaacggtgtcgtcgtcgacctcaacgtgctgttccaggagatcgacggactggaagcccgcggcatcgacacctcccggctgcgggtcagcgccaacgcgcacgtgatcgcgtcgtacaaccgctcgctcgacaaggtctccgaacgcttcctcggcgcccgccggatcggcaccaccggccgcggcatcggccccacctacgccgacaagatgaaccgggtcggcatccgggtgcaggacctcttcgacgagtcgatcctgcggcagaaggtgaccgccgccctcgccttcaagaaccaggtcctgtcgaagatctacaaccgcagcgcggtcaaggccgaggacgtcgtccaggaactgctgtcctacgtcgaccggctccggccgtacgtcgcggacaccgccctggagctctcccaggccctggacgccggcaaggtcgtgctctgcgaggccggccaggccaccctgctcgacgtcgaccacggcacctacccgttcgtgaccagctcgaacgcgacctcgggcggtgcctgcaccggttccggcatcccgcccacccggatcgaccgggtggtcgccgtactcaaggcgttcaccagccgggtcggcgagggccccttccccaccgagctgcacgacaagtggggcgactacctgcgtgaggtcggtcacgaatacggcaccaccaccggccgcccccgccggatcggctggctcgacctggtcatcggccggtacgcgactcggatcaacggcgtcaccgacttcgcgatgaccaaactggacaactacgacggcctcgacgagatcccggtctgcgtggcgtacgacgtgaacggtgtccggcacgacgagatgccggtcaaccagaccgacttccaccacgccaagccgatctacgagacgctgcccggctggaaacaggacatctccggctgccgcaagttcgaggagcttccccgcgaggcgcaggacttcgtcgagttcgtcgaggcccggatcggcgcccggatctcgatcgtcggcgtcggcccgggccgcgaagcggtcatcgagcggcactcggtgctcggcgaggcgtaggcatggtcgacgtcgtgctgctcagcctggccgagggatcaggcgactcgtgtggctccgggtgcggcggctgcaccgcggtctgcgccaccccgcgcaccccggtgctcgcctgcgccgacgtactgcggaacgccggcgccacggtggagaccgtgctcgccggctccgatcaggagatcgacgcggtgctggcccggttcgacggcccggcccggcccgacgggctgacctggccgtccctgaactcgccggcccgcctggtcatcgcggtcgccaccgacggccaactccgggcggtcgtacgccggatggtgcggcgctgggcaccggcccccagcaaacgccccgccgacctggaagccacccggaccgtgccggacctgccgccggtcgcgatcctgccgctcgacccgggcagcaccaccgatctggccgcccagctcggcctgccgcgcaccccggcggacgtggcgaacgccgtgctctccggtgccgtgcgccggctcgacctgctgcgcaacgacggcggctcggtgacgctcgacggagcgctgctcggcggcgccgacgacaacggcgcggcggtgccgtggcgcgggcgcgtcgaggtcgacgacagcgtgctcagcgagggcgaggaaccgatcctggcctgcgtgatcggcaacggcggcggctacgccgaattcgacgggctgcgactgctggccgagggcaaccctacggacggccgggtcgaggtggccgtggcggtgccggtggtggtgaaacagcggttccgcgggacccgggtgcgcgtcgaggtgcggcgggcccgcggccgggccgtctcggtgctgccccgggagggggaactgcagttcctcgacgacggggtggcggggtcgacgacccggaaacggtcctggtggaccgaggccggggcgtgggcggtgtacgcctagtcacgacgtcgcggtgcacggtgcctcggatccggggaaccgcagccggtcgacctgcgtcccatcgccggccgcctgcgcaatgccggcgccgcgcggtgggtgagacagaggggtgcaacggatgccggacatggctggcgagatacgacgagcggggatcgccttggccggctgtaccgcggccctgctggccggctgtgccggcggcaccgccgagccgccggtggccggcccgctcgcctccccggtgccgatgtcacgcaccggttccatcccggccgacgccatgcggcccgccggtaccccgcagatcaacgaccggtggacgtcgtgcgcggcggcgttccccgcgacgtcgtcggtgccctcgtcgtaccggattccgcgctacgacccgtccttcacggcggtcagcgtcatcatgtgcgtcgacgcgggcggcggcaccgtgcgcgaacgccgcaccggcgacgtggggccggttcttgccgcgttgcaactgcccgacatcccgcccctggaccccgaccgctgcaccgccgacggcgagatccccatggaactggtcctgctcgatgcccgggggcgttgggtgcgtccgggggtacccgctgacgtggtctgcgcgaagaggcgtccggaggttcagcaggccctgcaccggagcggcctcgcctaggccgcaccccggcgatcggtgatcaccggggtgcggtggcactcgctaccggtctgctaggagagcgcgtcggcggcggccgggtcgctgtcgcgcaggaactgggcgcagcgggcggcctcgtcggcctcgccgatcacggcggccgcctgggacagcacgtgcaggcagcggaggaagccctggttcggctcgtgcgaccagggcaccgggccgtggcccttccagccgttgcggcgcagtgcgtccaggccccggtggtagccggtgcgggcataggcataagcggtcaccggctcgccggcggcgagggcggcggcggccagcggggcccagaccgcgctgtaggccgggtatttcgccgcgaccgccttggacgcctcgtcggtgccggcggtcgcggcggcggcgagggcctggtcggcttcggcgtcggccgggagtcgggtggccggcggctcgggaaggaggttctgcatgaacccattctttcagccccggtcgcgccccacggtcagtcccaggtggtgcccagcttgaggaggcggtccgcgtactcgatctgcgtctgccagccggccggccaggcgccgaggccgagcgcggcgccggcgaacgcgccggccaggcaggcgatcgagtcggagtcgccggacgaggcggcggcccggccgagcaccgcgaccggctcgtccggcgagatcaggtagcagtagagcgcggtggccagcgcctcctcggcgatccagccggcgccggtgaccaggcacggatcgccctcggaggatccggtcgcgagcccggccgcgaccgcatccagggcggccgcacactcgtcccagccgcgggcgatgaactcctccggcgagtcgaccagcggccgccgccacagctcaccgagccactcgccgcggtagatcttgcgctgctcgtcgcagcggtcccggagggcgccgagcaggtgcgccggcgcaaggccgccacgaagccaatggacggcgtacgccgtgagctcactcgccgcgagcgcggtcggatgcccgtgcgtcatcccggcctgcaactgggcgatgcccgcccgctggtcgtcggtcaggccgggaaccaggccgaccggggtgacccgcatgttcgccccgcagcccttggagccggtctgggtggcctggatccacggccggccgtcggccagcgcgccgatcgaccgcagacacgtcatccccggggcacggtcgttctccgggctgtacgcccaggccatgaagcggcggcggagcaccggctccagccggcccggggtggggacgcgcacctccagcagcgcctcgccgaccgccagcgccatctgggtgtcgtcggtgaccagggccggctcgccgtgcaactgacgcggccccgcggggccgtatcgggacacgatcgccgagtagtccatgaactcggtgggcttgcccagggcatcgccgtaggccagcccgaacatcgatcccgacgcagcacgcatggtgcaactctaggttccccgttgttcatcgcgcatcaatggccggcgtgcggatttcccggcgtgaataccgacgggcggggtgtgcgttcgccgctcgcacgacgggagcaccatggaggcatgccggatccgctacagccggtgctcggcggcgatgcgccgttcgacgccaccgagttcgagatcgagtctcgcgaggagctcgacacccacctcgtcaagaacaccctggccgggctgatcgttctcggtcttcgtctcgaccgcaatccccccgacctgtccactgtcgacgtgcgggacaccctgttcgtcgggtgccggctggtctcccccgaggtcgaggtcgacctgatccgccgcggcgcgcacatcgtgccgccgttcagcaccctgccctacccgacgcatccggcgctgctctacacccccgacgacctggccgccggattcgccgagggcggcttcgccgggatgtacgacaccgtcgtctaccggcatttcgtggcacgtggcggggcggtgccggacgtccgtgaggcgctggcgcagcggctgcacgacgccgggatcgacaatgcgctgggcaaggcgctgtccgcgtgggcggccacgcacggcacggccggcccggtggggatcatgggcggtcatgccgaggcgcgcgggtcgcaggcgtaccggatggccgcgacgctggcccggcggctggccaagggcgggcggctgatcgtcaccggcggtggcccgggcgtgatggaggcggccaatctgggagcgtatttcgcgtcccgcaccgagcgggagatggccgcggcgatcgacatgctggtgcccgcacccgacttccgtgaccacgacccgtacaccgcggcggcgctcggcgtccgggccacctacccgctgccggccgtcgacctcgccgaccggttgcggtacggcgggctggcactgccgacctggctctacggccacgagccggccaacctgttcgccgggcagatcggcaagtacttctccaacgccgtgcgggaggattcgatcctgcggctgtcccggggcggaatcgtcttcgcgcccggctgggccgggacggtgcaggaggtgttccaagcggcgaccaagacgttctaccgcaccgacgggccgtccggggcgttcgtcttcctcggcgccgaccactgggccaagctgccggtggtggacctgctgggcaccctgctggcccgttccccgcacggcgaccagtccggcctgatcctcgtcaccgactccctcgacgaggcgatgaccgccctcaccacctgacgcccgccgcgcccgcttccgattgtcgagccggctgatgttcttcgttctcctccgcacggtcccgatgatcatcgtggtcgccaccctggccgtccggcgccgccgcaacagcggcgacccggattaccacggtccggcgtcgaccggctacgaaagcggcgcgacgcggttctacggcgccaccggcagcaacggctgacccggggccctgcccgccggggcgggccccgggtcaggcgatgtgcacgcgacgccagtgcaccggggggagatccgattccggtacgtcggtgaggccgttctcgtccatcgcgttgtagatggcgaggcgcgccccgtcgaagaggaactcgatcgcgtgcagtacccgaggccgccagtccgccgacgtggtgcgttcgatcgcgttgaccgcgcgcagctggcgacctcgggcgtggcgcagcgcggcgtgcgggtcggcccgccagtcgaaatgctcatacatgtcgatcggcaccgacatgtcgatctgctcccaggtgatcgcgcactcgtcgaacttacggtgtgtgatctctacgcgactgagtccgaagtcgaggatcaccgggccgtcggcgaaccagcctcgctgcgccacatcccagagcagccagcttgatcgcaactttcgtccgatgagccgcacgaacatatgtcgatgcgtcgcggcgagggcttcggcatcgtgatgccactcgggtttccagccctcgatagtgagcacgatcaccgcccctagatcaagactggacgatcgtacccacgccgctgcgtagtcatgcaagacgacagcggccggtccccgccatcggggaccggccgcggccgaaacgcctacttcgagagagttacttggcgagcgtggtgccggtcgagcggaggtgctcgcaggcctcgacgacgcgcttggccagaccgttctcggccagcttgccccaggcgcgcgggtcgtacgccttcttgttgccgacctcgccgtcgatcttcagcacaccgtcgtagttcttcatgatgtggtcgaccaccggacgggtgaacgcgtactgcgtgtcggtgtcgatgttcatcttgaccacgccgaagtccagggcaccgtggatctccgagagcagggagccggagccgccgtggaagaccaggtcgagcggcttctccttgccgtacttcgcgccgatcgcgtcctggatctccttgaggatctccgggcggagcttgacgttgcccggcttgtagacgccgtgcacgttgccgaaggtcagcgcggtcaggtagcggccacgctcgcccaggcccagcttggcggcggtggccaggccgtcctcgacggtcgagtacagcttgtcgtcgatcgcggcggagacgccgtcctcctcgccaccgacgacgccgacctcgatctccaggatgatcttggcggccgcggcggaggccagcagctcctcggcgatctgcaggttctcgtccagcggcacggccgagccgtcccacatgtgcgactggaacagcggggccaggcccttgttcacgcgctcctgggaaatcgcgatcagcggacggacgtacttgtccagcttgtccttggggcagtggtcggtgtgcagcgcgatgttgaccgggtagtgcttggcgacctcggtcgcgtactcggccagcgcgacagcgccggtgatcatgttcttgatcgtcgggccggacgcgtactccgcgccgcccgtcgagatctggacgatgccatcgctgccggcctcggcgaagccctgcagggccgcgttgagggtctgcgaggacgtcacgttgatcgccgggtaggcgaacgcgccggccttggcgcgatcgatcatttcggcgtagacctcgggagaagcgataggcatcggtgcgctccttgctctttcatccgggcagcagagggcaggaccgcgctgtcctccagcaggcagtattccgcagttgccgtgcgtagcggaaatcggtccgatattcgcccgggaactaccggcgaaccggggcccgtgagttctgctgtggcaccacaaccctggtgttaccacgaccttcggcactccgcccggcctcgccggtcgccactgtcggtaaccccgcgggtggtgccggtttgtgcggcatcagtgcgggcaagcgcgcaccatggagctgaagccggcggcacgggaagggagccgaggatgatccgcctgacagaggaagccgacgtggaaacccccgaggtggacgccgccgagcaggcggtgatcgccgtcccctcctggcaggacgacgaacccgccggaacctggtcggtcaccgaggccaacgagtgggacgccgcggaacagcaccgcatcgtcgagttcgacgacgactaccgctgaccccacccgccgcggcggccgcgcgggacgcccacggccaaattccccatcgagagttgtccacaggctcggcaatttcgatcgcacggatgccgtcgcgctgccaccatcgaccacgtgctgctcaccgtgacgaccacccaccggcccgcgaccgacctgggctacctgctggtcaagcatcccgaccgggtccatgagttcgacatgcccaccggtacggcgtacgtcatgtatcccgaggccaccgacgcccggtgcaccgccgcgctgctgctggacgtcgatccacagcggctgcgcgcccgggccgacgccttcgagctgagtcagtatgtgaacgatcgcccctacgccgcctccagcctgctggccagcgccctgtccaaggtgttccgcaccgccctgcgcggcgtctccaaggaccgtccggaactggccgccgaggcgatcccgctggagatccacgtgccggtgctgcggggcagcgccgacctggtcacccgcctgttcgccccgctcggctgggcggtgaccgcctccgcgatcccgctggagccggagctcggcggcgacagccgctatgtcgacctgcgcctggccggcaccctgcggctcgcggacgcgctcaaccacctctacgtgctgctcccggttctggacgacggcaagcactactgggtcgccccggacgagatcgagaaactggtgcgctccggggccggttggctcgccacccacccggagcgggtgctgatcgcccggcgctacctggcgcaccgcaagtcgctggcgaccaccgcgctggacctgctcgacgccgaccagccggccaccgaggaggaggccgagctgccggtggcccgcaaggcgccgctggccgagcagcgccgggacgcggtgctcgcggcgctggccgaggccggggccagccgggtgctcgacctgggctgcggtcccggcgcgctgctcagcgccctgctcagggactcccggttcaccgagatcgtcggcgccgacgtctcctcccgggcgctcgatcaggcggcccgccggctgcggctggagcggatgccgcagcggcagcgcgaccggatcaagctcatccagaccgcgctgacgtatcacgacgatcgcctcaccggttacgacgcggccgtgctgatggaggtcatcgagcacgtcgacccgccccggctgcccgctctggaggccagcgtgttcggccgggcccgccccggcgcggtcgtcgtgaccacgccgaacgtggagtacaacgtgcactacgcgggtctttccggcatgcgccattcggaccaccggttcgagtggacccgcgcggagttcgcggcctgggccgcggacgtcgcggagcgccacggctacacggtgaccatccgcggcgtcggcgacccggacgagaccaccggggcgcccacccagctcgctctcttcacccggacggaggtgaccgcatgatcgacattcccgagctcagcctggtcgcgctcgtcggcatctccggatccggcaagtcgacgttcgcccgctcccacttcgcgtcgacccaggtgctctcctcggacttcttccgcgggctgatcgccgacgacgagaacgaccaggccgcctccgccgaggcgttcgacgcgctgcactacatcgccggcaagcggctggcggccggccggctcaccgtggtcgacgcgaccaacctgcagtcgcacggccgggccgccctgatcaagctggcccgcgagcacgacgtgctgccggtcgcgatcgtgctggacgtgcccgaggcgctcgcctgggagcgcacgcaggcccggccggaccggacgttcggccgccaggtcgtttcccggatgcaccgtgacctgcgacgctcgctcgggcagctggcccgcgaggggttccgcaaggtgcacgtgctgcgcggcccggaggagatcgcggccgccgagatccgctacgagaagctgttcaacgaccggcgcgacgagcacggcccgttcgacatcgtcggtgacgtgcacggctgccgcgccgagctggagacgctgctcggcaagctcggctgggagctgatccgggacgcggccggccgcccgatcgacgcgacacatccggccggccgcaccgccgtcttcgtcggtgacctggtcgaccgtgggcccgactcgcccggcgtgctgcgtctggtgatgggcatggtggcggccggccacgcgatctgtgtgccgggaaaccacgagcagaagctggcccgcaagctgaacgggcgcaacgtccagctcacccacggcctgcccgagacactggagcagctggccgccgagccggccgagttcgtcaccgaggtgcggaccttcatcgagagcctggtcagccactacgtgctggatgacggcaagctggtggtcgcgcacgccgggctgaaggaggcataccaggggcgggcctcgggccgggtgcgcagtttcgcgctctacggcgagacgaccggcgagaccgacgagtacggcctgccggtgcgctacccgtgggcgcaggagtaccgcgggtccgccgccgtcgtctacggccacgtgcccaccccgcgctcggagtggctcaacaacaccatctgcctggacaccggctgtgtcttcggcggtgccctgacggcgctgcgctggccggagcgcgagctggtcgacaccccggcggccaaggagtattacgcgccggtccggccgctgttcacggccgtcgccgaaccggaccgcgggctcgacatcgccgacgtcaccggccgcaagcacctcgattacgggtacgggcggaccaccgtcccggccgagaacgccgccgccgccctggaggtgatgggtcgcttctcggtcgatccggaaacgctgatctggctgccgccgacgatggcgccgtgctccagctcgaccgtcgagggttacctggagcacccgtcgtccgccttcgccgacctgcgcggggccggcgtcgaccgggtggtctgcgaggagaagcacatgggctcgcgggccgtggtccgggtctccgcatccggcaccggtgacgcgatctggacccggaccggtcgcccgttcttcgggccggagctcgaccagccgctgctggcccgggtgcgcgccgcgatcgagccggtcctggccgagctggagaccgagtggctgctgctcgacaccgagctgctgccctggtcggccaaggccggcagcctgatccgggagcagtacgccggggtcggcgcggccggccgggccgcgctgccggtcgccctggcggtggtcgaccaggtggccgggcgcggcctggacgtggccgccctgcgcgaccggctcgccctgcgctcctcggagatcgacggctactcggcggcctaccggtcgtacgtgaagccgaccgacgggctgaccggcgtcaccctcgccccgttcgcggtgctggccggcgccgggacgacctacgcgaccagggaccacggttggcacctggcgatcgccgaccgtctggtggccgccgatccggagctgttcaccccgacccggcggatggtggtcgacctggccgacccggcggctgaggcggccgccaccgactggtggctgaccctgaccggggccggcggcgagggcatggtggtgaagccgttcgccggtctcgccgcggtcgacggcaagggccggctggtgcagcccggcgtgaaatgccgcggccgggagtacctacggatcatctatggcccggagtacacccggcccgagcagctcacccggctgcggcagcgcaacctgggccggaaacggaacctggcgctgcgcgagcacgggctgggcctggcggcactcgaccggctggccgagggcgcgccgtcgtggcgggtgcacgagctggtcttcgccatcctggcggccgagtcggagccggtcgacccgcgtctatgagccggatcccgggggtgtccgccgatgcccccgggccggtgaccagcacaaggtatccacagcggtcgtacaggtgagggcgaccggagggccggtaccctgcttctcgtggacatccgtgcgctcaccgagcagctcgccctcaacccgttggacgcgagtcaactgctgcacaccttcggcctctacggggtgtgggccatcctcttcgcggagaccggcctgctgatcggcttcttcttccccggcgactcgctgctgttcctggcgggcatcgcggcttcgccggtggctgacgcgctgttcggcgacggcacccggatctcgctggccggcctgctgatcggcgccccgatctgcgcgatcgccggtgcgcagttcgggcactacctcggcgcgcggtacggccgccggatgttcgagcgtcccgactcgaagctgttcaagcgcgagtacgtggacaaggcggagcactacttccagaagttcgggccggccaaggcggtggtgctggcccggttcatccccgtggtgcggacattcctcaacccggtggccggcacccttggcatgccggcccggcagttcctgctgtggaacgtggtcggcggcgtgatctggaccgacggtgtgctgctgatcggctacgcgctggccaagcagatctaccacgcggtcggcgacaagatcgaccactacatcctgccggtcgtcgtgatcatcgtgctgatctcggcgctaccgatcttcatcgagatcctccgcgagcggaaggcgaagaagaacggcacgcacaccggcccgcagccggccgccgcggtcggcgtcgtcgccgcggccagcatcgccggcctcgccgaggcggcccacctgcgcgacgaggacgacgacgaggatcgcccgcgccggccgcgttcgcaccgcgcctgaccagacgtccaccacgacggccggtccccctcccggggggcaccgcgcctgacctgacgtccaccacgacggccggtccccctcccgggggccggccgctcgcgcatccggcccggcgttccggcgcggcacgaccgctcggcggcgcggtgcgatttcactccatggcgatgaggcgtacgtacgccatcgagacctcgaagcccagcgagccgctagtgagcggcggcgagggagtggtgacggttccgtgaatcggccggcccctggagcggtgtgcgaatcgtccgcaccctgagcggcgatggatcggccgggcggacagcagccggccgggatgaggccgagggaagggacgcgatccagccggccttagggacggccggctggcagcgtcggtgtggtgcgtcagacagtgaccgcggcggagccggcgagccggtccaggaatgcctccgggcagtcccggagattctccaggcggccggcggcgagagcgcggtatgtcagcgtggccgcctcctccaggttgcgggcacgtttgtgcgccaactccaccgagtcgcccatcacgacgcaaccgtgctggctgagcaccaggcagtcggtcccgtcagcggccatggccgcggtcagcgcggccagctcggtggtgccggggagccggaacggcacggtggacactcggcgcagatagaacgcgtggtccgtggtgacgatccggatgtgctcgccgagcgcgtcgagcagcaacgccgtctgcggatgcaggtgcaccacggcgttgacgtccgggcgggcccggtacagagcgagatgcagcgcaagctcgctggtcggctcgatccgcggcggcggcatgttgccgatcgccacgacctcaccgtcggtgatgtcgaccggcacgaagctgggccggctgagccggtcgagccaggtaccgctcgcggtgatccagatggcgtcctcgtccggaatccgtgcggacagattgccgccggatccacagaccagacccgcctggaccacgtcgtaacccacgtgcgcgagctgatcacgcaggtcaccgggcacgtagttcacgcgtccctcctcgaatcgccaggggtggccggggaagaggtcctcggcctggcgtcacgccccacgttccagtgacgccaggcagtgcccatcgatcagcgagccttcttcgtcgcccgcttgcggggcggcgtcagaaggtcggcgatggtcgcgatggcggtcggcacgaggcggtagtacgcccacaccccccgcttctcgcgctccagcagacccgcctcggtcaggatccgcaggtggtgactcacagtcggctgcgaaaggcccagcggagccgtcaggtcacagacacacgcctcaccgtccgtcgctgactggataaggctcagcagccgcagccgtgccgggtcggcgagcgccttgagcactcccgccaggcgctcggcgtcggcgcgttcaataggctcgccggcaagcggcgagatctgaggcatcgtcatttccgccaacgcagttcccacgatctccatccttccaccaactgcatcgattctcctgcatgggtgcaggaacgaaccggctaactttcaggccgtaaggccgacttcgatcgccgtgtcggtcaaccggcgacgcgacccggggacccggcccacaccactcatccgatcaacctttccgccgacaccgacttcggtctctgcctcctgcaacgcctcagccgccacttggtcgctacccatccgtgtcgagctctcgatccccatctcgggagtgagccaacccacattgtcaattcatcgattgtttcggttcaccgatccgaacgatgactcggcacggaacgcgtcgacaccatcacgccacgctgcgcgatcaacgggtcgctacgcgcctcacgacccgatgaaagcacgacgccacgctgtgcgacgggcaattcagtgatgaatttacccaggtcgtgccgtgccttcatgacatcgagcgtactggcttgaaggaaaccggaatctttcgccccgccgggacggaacggaactattgacccagggctctgcacgcctctgtaaagaaggtttaccaaaggtgcaacggatctcgacctttccggcgaccatagatgcagctcaaagcacctaacaccgccacggtacccatccacccctcaagatgacctggtagccgcgctgtgagagtgctgtgaacccccggaatcacgtttgtccgtccaggcgaaaacacccaccggacggccgatctactgctatccggacagccgatcgggtgacagtgaaggaaaccgtctgtacccgttcgagtgacccacagtcgtcgatacgagtccggatctaggcgtggttccgcatggtcactcttccggtcggcgccagtattcgtcatcagatccaggcgcggggcggttcgccccaggatcacccgggcgagcggagtctccgatgtgtccttgcccacgctgcgtaaccggactcacgtttgaggaagcgttcgaacggtgcgtgacgctgtccgacgatcgctcgccctccccggaagccccttttgcgaccccgccggaagtacccgagtcacccgccgcgccaccatcgacacccgccaccgtcgggaacccgaccgatgcgaacggcccgtcacccggcccggcgggggcccgagagccatcgaaggttcccgccgccgagccggccggggcctgagatccgtccgctgcccccgacggtcgagccgagcccggaagagcatcgggcgtctccggggccggctcggccggatgcgcggtgggatcggcggtcgcagacgacggagccggggctgccggggctgccggggctgccggggctgccggagccgaagctgccggagccggcgctgcctgagccggcgctgccggggcttccggggccggggacgctgacgacactgcagcggccgactgggtcgggacgccaccgatgggcggatatccggacggagacgcggccgggggcatgtaggcggagtgatccaccgaaggcggcacgggcggcgtgaagccgggaggaccggccggaccgtacggagaaaggtgcggagcgtaaggcgaaggggtcatcggcgcaccgcccggctgctgcgggagcgcaccagcctgagcctcggaatcccccggctgtgcgacgtacgcaccgagcccgggataggcgctggagcccgggtaagcacccggccccgggtaggcgccggaccccggataagcacccggccccgggtaggcgccggaccccgggtaagcacccggccccgggtaggcgtcgccggaccctggatatccgcctgatcccggatagacgccggacacgggaaaagcactggatccgggatggtcgccaggcagcgggtaggcggtgggcgcggaataagcgccggaacccggctggacgccgggcacggactgggggaatgcgcccgggtaggcgccgggcgcgggctggggcaacacgccggggtgcgtgccgggtccgggctgcgggaacgcgctcgggtgcgtgccgggcgggctggccgggcggctgggggccaggccgaagaaggcgcgcggggaggcgaggagcatcgccccgacggcgaggtagccgagggcctgcagggcgcagacgacgatgttgaggccgagccagccctccgggtaggccgagcccagggcgtcgctgagcgaacccggcgccgggtcgccggagcgctggacgacggcggtgatgaggccggcgacgccgccgagcgtgcccagggtgcagacgaccagcgcgacgatccgggcggcccggctgccccggcgcagggccaggccgaggaccacgaacagggcgaagaacaggatcgacagcaccgcggacagggcggcgcccagccagacgacggtgacgaagttgtccgcggcgtcgccggaggcggcgtcccggaaccggctgaccgtgccggtggcgacgacgatcgtggcgatggcatagagcagtccggccgcgcccatcagccacaagagggtggaggcggtcgtcacggcgggcggccgcgcgccggtggacggcggcggcggcgctgcggtgacgggcggctgggcggaataggacatcgatcgctcccgcggtgttcggctggcaggaaacctaccgcgtcgccggggtgtgccgtgggcggaccggaatgcctgtggataactgaaccggtccgcctgtggacagacggaccggttcgggaaatgcgcggcaggatggacgggcgccggccgatcgggccgggccggtcgatcaggccgggtcgtgcggcggccgctggccgtcggccgaggaagccggcggcaactggtcgccggcggctgaggaagccggcggcaactggtcgccggcggctgaggaggccggcggcaaccggtcgccggcggctgaggaggccggcggcaaccggtcgccggcggctgaaggagaggagtgggatccaccggagggcgacgagcccgaggacgacccggagtcggaggaggacgcggccgaagaggccgaagaggccgaagaggccgaagaggccgaagaggccgaagagggagcggacgagggagacgaatcgtgagccgaatctgaggacaccgctgaaggcgcatcaccggtgtcggacggcgcccaaccggccgacgagtcagcatccggcgacgagccggacggcaacgggctgtgcgtcgacgaatcggacggcggtggcgggacggacggcgacggcgacggcgacggcgggacaggcggtgacggcggcaactgccagggatcgctgggcggcccgaactccgccaacggatccgacggcggcggcgagcccgctgcggcactcggcgacgcatacggcgtcgccgagccgccagggcccgcgggcgagtatccgggcggcgggtaggcacccggtccgctcgtcggcacccggtaggcgccgggaccgctcgtcggcgccggataggcgccgggaccgctgaccggcggcgggtacgcggcaggctgccccggatagggcggcagtccgggagcgggctgcccaggctgcccgaaccccggctgcgcggatgcgccatgtcccggctgaccaaaggcgccgggctgcccgggcgatccgggctgcccatagccaccagccgaacccgcgccaggctgcccatagccaccagcccaacccgccccgggctgcccgtaaccccccggatacggctgcccgtaagccggctgctgcggataccccgcccccgcctgcggataccccgccggatatcccggctggtacggactccacccgccggtcatcccccggaagaaccggttggacggcggcaccgagagcaggatcaccaccgcgatcagggcggccagcgcgaacagcgtgaagaacagcccgaaggtgtcgaaccagtccggcaccaccccggccagccgggtgtcgagttcgtgctggctgggcagcccgctggtcccgttcgagtcgtgcaccaccgaggcgaagtcggtgaccagggcggtcatggtcgacggtacgacgactgagcagcacatcagcacaccggcggtgacccaggtgatcacccgggccggctgtttgccgcgcaggttgaagaagccgagcaggcccagcccgatcgccaggatcagatagacgatgatcagcaagacgccgatcgtggtgatgccggtgccgatgtcctggaagtcggtactgccgtattcctcgtcgtagacgtcgccggccttgttgagcgcggagaaggcgaggatcgcgtaccccacctggaggaccgcgacgatgaacagcagcaccgacgcgacggtcacggtggccgggcgaccccctggcggtggcggcgccgctggataggacggggggtatgtgggaacggtcacagagtcctcctctagatccattcacggtatcggccgggggcgaggaccgcgaccggcccacacgctgcgcaagcctgtggcaacatcgggcgacgatgcctcaaatcgccgcaaagggtcgctcgttcgaggggctacatcgctggccgccaacccctagactccatcccgtggcgcctggcaggtatcagagtcctccagtgccgccctctgccttcatgagtcgcccgccccgctcacctatcgccggggccgaggctgaccgtccacgggcaccttccccattacgccggccgcgtgagcacaccgcggccaccccagacctgacaaggaccggtgagtcccatgccgcacgcagacaccctgaccgtcgttcaccatgacgacacccggacccgtttcgaggatgtccggtatcaactccatcgtgacgggatcaggatctggtccgctgacggcgaacacgccttctcggacattctgatgacccacgcctaccgacaccagaaaaccgcttcatagcgacaaaatgccacaagcgaggccccgggggtatgtacccccggggcctcgtcgtcacccgcggccgaactccgcagaacccggagtctcagccgcgctggaccgccagcccgtccttcgccgagttcaacgccacctgcacggtgtccccgtcccggatctcaccggcgagcagggccttggccagcaggtccccgatcgtcgcctggaccagccgccgcagcggccgggctccgtagatcgggtcgtacccgtgctcgcccagccagtccaccgcatcctcggccaccgacagggtgagccgccgctcagcgagccgggcccgcagccgggccagctggatgtcgacgatcctgatcaggtcgtccctggtcagggcgtggaacaccacgatgtcgtcgagccggttcaggaattccggcttgaagtgcgcccgcaccgcggcgagcacctcgtcgtgccgctcctcgtcgctcatcgtgaagtccgagttggccgagcccaggttcgaggtcagcaccaggatcgcgttgcggaagtcgaccgtgcgtccctgcccgtcggtgagccgcccgtcgtcgagcacctgcagcagcacgtcgaacacgtccgggtgggccttctccacctcgtcgagcaggacgacgctgtacggccggcggcgcaccgcctcggtcagctggccaccctcctcgtatccgacgtagccgggcggggcgccgacgagacgagccacggagtgcttctccgcgtactcactcatgtcgatccggaccatcgcccgctcgtcgtcgaacaggaagccggccagcgccttggccagctcggtcttgccgacaccggtcgggccgaggaacaggaagctgccggtggggcggtccgggtcggcgatgccggcccgcgcccggcggaccgcgccggccaccgcggccacggcctcgcgctggccgatgaccttggcctgcagcgactcctccatgcggagcagcttggcggtctcgccctccatcatccggccggccgggatgccggtccacgaggagatcacctcggcgatgtcgtcggcgccgacctcctccttgaccatcggcggctcggtcgtctcctcctccgactcggccgcggtcgccagctcccgctccaggcccgggatgacctcgtagagcagccgggacgcctgcagcaggtcgccgtcgcgctgggcccgctcctgcgccgcccgcgcctcgtcgagctgcttcttcagctcgccgacccggttcaggccgccgcgctcgcgttcccagcgggcgttcagcgcggtcagctcctcctcgcggtcggcgaggtcgcggtcgagccgctccagccgggccactgaggccgggtcggtctcgcgttcgagggcgagcttctccacccgcatccggtccacctgacgctgcagctggtccagctcgaccggccgcgagtcgatctccatgcgcagccgggaggcggcctcgtcgatcaggtcgatcgccttgtccggcaggaaccggtcgctgatgtagcggtcggacaggctggccgcggcgaccagggcggcgtcggtgatctgcacccggtggtgcgcctcgtaccggctcttgagcccgcgcaggatgccgatggtgtcctcgacggtgggctcgccgaccacgaccggctggaagcgccgctccagggccgggtccttctcgatgtgctcgcggtactcgtccagcgtggtggcgccgaccatccgcagctcaccgcgggccagcatcggcttgagcatgttgccggcgtccatcgaaccctcgcccttgccggcgccgaccaccgtgtgcagctcgtcgaggaacgtgacgacctgcccgttcgacccgcggatctcctcgagcacgctcttgagccgctcctcgaactggccccggtactgcgcgccggcgaccatggcgcccaggtcgagggagaccagtttcttgtcgcgcagagtttccggtacgtcgccggccacgatccgctgggcgaggccctcgacgatcgcggtcttgccgacgcccggctcaccgatcagcaccggattgttcttggtgcgccgggagagcacctggaccacccggcggatctcggcgtcccgcccgatcaccgggtcgatcttgccctcgcgggccagcgcggtcaggtcgacgctgtacttctccagcgccttgtaggtctgctccgggtcggcgttggtcaccttccgatcgcccccgcggacctgcggaaatgccgccaccagcgcgtcctcggcggcgccggccgctttgagggtctggctgaccgcgccgccgccgcgggccaggccggccagcaggtgctcggtcgagacgtattcgtcgccgagcggctgggcgatcagctcggcctcaccgatcgcgttgacgaactcccgggacaggctgggctcggcggtgctggcaccgcgggcgctgggcagctgctcgacggcgcgggcggcggcccggcggacgtcggccgggttggcgccgacggcgcgcagcagcgccggcgccgtcgaaccggcggtgtccagcagtgacagcagcatgtgccacggctccaccgtggcgtggccgctctgcgcggcggtggccaccgcgctcttgatcacgtcgcggctcttcgtggtcagacgttcggcgttcatgagctcccctggtcggttcccaacgggtacaaccccacagacttgagcgtattccactcaactctaacgcgtgtcggaagggtgacagtcaccatcagcgagagcgctctccagcgagataggttggcaaggtgacgcgcctcctgtcgcggcggctggtcccgctcggcttcatgtttctcgcctccgggatcgcgaccgcggtggtcggcccgttcctcggcctgttcctcagcaccgcggtgcacgccaacccgttccaggtctccgcgttcctgatcgtcgcgtcactctccggcgtcggcatgtcgcagttcatcgcccgcgtctcggaccgccggccgatgcggcggatgctgctgatcaccgccgccctggccggcttcgccggcaccgggctgacctcgatggtgcgcgactactgggtgctgctcgcgatcaccatgacggtcaccgcactggccgggtccttctacccccaatctttcgcgtacgcccgtcaggtgctcgcccgcgaagacccccgccgcgccgcgatggggatcagctcgctgcgcaccgtcttctcgatcgcctgggtcggtggcccacctctggccgcggtcctgctcgacgtcggctcgttccgctgggtgtacggcaccgccgccgtgatgtacctggtggccgccctgatcgcgacccgctggctgccggaggcggaggcgcccgccccggccgggcagagcagccgggacgacacccgcccaccgcgcgtgatgtatccgatcatcgccgggttcgtgctgctcaccacgacgatggtgctcggcgtgcaggccatgtcgctgtacgtcaccgacgacctgcacggctcggtcggtgacaccggcctgatcctcgggctgtgcgccgcgctggagatcccgctgatgctgggcttcggtgcgctgagcacccgggttccgctgcgccggctgatcctcggcggcggcgtggccgcggtggcctaccagacggtggccgccaccgcgcactccaccgggatgttggccaccgcccaggtgctgaacgcggtcttcatcgccacctgctccgggctgggcatctcctacgtccaggatctgatgccggcgcatccgggccgggccaccacgatgttcaccaacgccttcccgatcgggaacatcctggccgcgcccctgttcgggttggcccaggaattcggctaccgactcgcgtacaccatgaatttgatcttgacggtgctcggtctgctcctgcttctggtggcgaagccgccggcagaaatcgcgaggccgcgggcggcggacaaagcggagagggaagcggagccgatcgggcccgaggccgcggccgaagcgggataacgtggggctcgtgcgcgtacgggtggaacagacctcactgccgggtatcggtgtccgacacgacctggtcacctcctccggccgcaccgtcggagtggtctcgcaccgcaacggccgccgtgacctggtcctctacgacgtcgacgacccggatgcctgcctcgcctcgatcccgctgaccgacgacgaggcggaggcgctggccgacgtgctcggcgcgtcgctgatgctcagccagttggccgggctgcgccagcaggcggccgggctgctcaccgagcagatcgcactgccggccggttcgccgttcgtcggccggcagctcggcgacacccgcgcccgcacccgcaccagcgcgtcgatcgtggcggtgctccgcgatcgcgaggtgatcccgtcgcccggcccggccttccagttcgaggcgaacgacgtggtcgtcgccgtcggcacccggcacgggctggacggcgtgacggccatcctggccggcgacaccaccggctgacccgccgtgcaccacaccacggtcctgctgatcgagatcggcgcgctgctgttcggcctcgggatgctgggccgggccggccgccggttcggtctctccccgatcccgctctatctgctggccggcctgttcttcgggcacggcggcctggtgccgctctcggcgagcgaggagttcatcgggatcggcgcgcagatcggggtgatcctgctcctggtcatgctgggtctggagtactccgccgacgaactggtcggcaacctgcgctcggcggccccggccggggtgatcgacatgctgctgaacgcgctgcccggcgccctgttcgcgctgctgctcggctgggacgcgaaggcggcgctggtgctggccggcatcacctgggtgtcgtcgtccggggtgatcgccaaggtgctcgccgatctgggccggctcggcaaccgggagaccccggtgatcctctcggtgctggtgatcgaggacctggcgatggcgttctacctgccgatcgccaccgcggtgctggccggcgcggggctggccggcgggctcagcacgctcggggtcgcggtggtcaccgtggtcgcggtgctggtcgtggcgatccgctacggcggcgcgatcagccggttcatgtcggtgaaggatccggaggccctgctgctcagcgtgctgggcctgaccctgttcgtggccggggtggccgccgagctgaaggtttccgaggcggtcggcgcgttcctggtcgggatcgcgctctccggtccggtcgcgcaccacgccaccgagatgctgtcgccgctgcgggatctgttcgccgcggtcttcttcgtcttcttcgggctggccaccgacccgtccgacatgccgccggtgctgctcccggcgctcggcctggccgtgctcaccatgctgaccaaggccgccaccggttatctggcggcccgccgggtcggcgtggcgctgcccgggcggctgcgggccggactggcgctcaccccgcgcggtgagttctcggtggtgatcgccgggctggcggtcgcctccggggtggagccccggctggctccgctcgccaccgcgtacgtcttgatcaccgtcgtctgcgggccgatgctagcccgcctatcagactacgtttggttcaaaaatttggtcagacggcggatggcggcccaacggtcatctacaaaacccctgcccagcgcggagtgacgcgaccgaccgtcgcgcgcccaaaaagttaccgtccagtatctgaatgtgaactcttgacacttccgttcacccgttgatcgcgctaccgttgcgccgcgacgactctctgtattgggacgttcgacactcgcgacggacagtgggtcatccgtcgcgttccgaacggtaaataaggcggcggcgttgagtttgcgagaggcgactttcatcgggttcggcaacccggtcgatccccggccggtggagctggagtcctgggcctaccaccccgaggcggtgccgctgagtgcgatgccgaaagactgggatctgctgatctccggcgacgtgctcggccccaccctgttcgagctggccatggaccggcagtgcccggcccgccggttcgcgcagcactgcatgtacatctatgcggcggacggcgtccggcagaacgcgaccagccagcgcaagcggcggctcaagaagttcgtggagcgcgccgaggaggtcggcgacgagccgatgcagatctgggcgcacaactgccgggtcctgatgacccggccggagctgttcgaccaccatgactggatggagggcggcctggtgcgccatccgcgccggatcggcctcttcaaccgacggtaatcagtcggtcactactcgacgtgacggcggccctctccacccggagggccgccgctcatctgtccggggagcgtcgcggccgccagacgaccagcgccgtcgagtgccgttcctggcgtaccagatcaccccggctcacgtacgggttcatcgattcaacttcggcgatgcgggcgtacgcgtcgtccagctgctgttccagctcgacgacccggtgctgcaggtccgcgaccagctgctcgaggccgatgatccgcttgatgccggccaggttgacaccgtcctcctgactcagcttctgcacctcgcggagcagcgccacatcgcgctcgctgtaccgtcggccaccaccgccggcccggccgggctgcaccagcccgagccggtcgtactgccgcagcgtctgggggtgcatcccggcgagccgcgcggccaccgagatgatcaggaccttcgcgtcggaggcctgttccaccgagatgctgatctcctcatacatgtgccacctccggagggtccctagccggtcttgcgcacgcgcgcttcgagtcgctcccgcccggcgggcggggtcagtttggcgaaccgctccagcgcgtcgcgcgcctctccggtcacgcccaccgggatctgcacctcgaccgtgacgatcaggtcgccggactggccctccttgcgggccacccccttgccccggacccgcagcttgcggccgctcggcgtgccgggcggcacccgcagcgtcaccgggttgtccaggctgggcacccgcaggtcggtgccgaggacggcctcggccacggtgatcggcacggtcagcgtcagatcgtcgccgctgcgcccgaacagctcatcgggccgcaccttgacctgtacgtacaggtcgccggccggaccgccgcggtcacccggctcgccgcggccggacagccggatccgctgcccgtcggcgacgccggccgggaaccggacgttgatcgtccggctcttggtgacgctgccgctgccccggcactccgggcatttctcgtcgacgatgctgcccgagccggaacagtcccggcacggctcggagaaactgaacgagccctggttgctggagatcagcccggtgccgtgacacttcgcgcaggagcgcgggatggttcccggcttcgccccgttgccgtgacaggtgtcgcaggcgccagcggtgcgcagtgtgagcggcagcgtggtgccccgcacggcctgcgcgaagtccagcgtcacctcggtctccacgtcgcggccgcgctgcgggccacgccggccggccggggcgccggcggcgccgccaccggagaagatcgagctgaagatgtcggagaacccggtgccgccgaaccggcggtcggccccggcgccaccgccggcggccgccccggtgaacccgccgaacaggtcggacgggtcgaactgggcgccaccggcaccgggccggccggcgccccggcggaacgcgcccgagccgaacagcgagcgcatctcgtcgtactctttgcgcttcttgtcgtcggcgagcacgtcgtacgcctcggaagcggccttgaacttctcctccgcctccttgttgtccgggttgcggtcggggtgaaggtcgcgggcgagtttccggtacgccttcttgatctcgtcggtcgaggcggacttgttgacgccgagcacggcgtagaagtccttctcaagccagtccttcgagctcatgcgacctccctcctcgacttgcgggtgcggtcccgcccgccggcgaaccggcgggcgggaccgggacggaaactcactccggatctgcgacggcgaccatcgccgggcgcagcagccgctcgcccagcgtgtagccacgacgcatcacctcgacgcaggtcggctcggtgacgtccgcggacgtcaggtgcgccaccgcctcgtgccggttcgggtcgaaggggtcacccttctccccgaacgcgaccaggccgagcttgccggtcaccgcggtgagctgctcggccaccgaggcgaacgggccgaccaggtcaccgtgctcgcgagcccggtcgatgtcgtccagcaccggcagcagcgcggtgagcaccgagccggtggtctgctccgccgcggcgccccggtcgcggtccacccgcttgcggtagttcgcgtactccgccgtgacgcgctgcaggtcgtgggtccgctcgtcgagctcgccgcgcagcgcctccagctcggcgccaaggccgggcttgctctcctcggccaccggggctccgccctcctcttcgtcgcgggcgcggtgcgcgccggccgccttccgcttcgtgtcgggagtcgtctcggcagccgagtcggtctcgccctggatgacttcccgctcggtcaccggaccgtcgttgtcgtcgtccgcggcactcacttcttgtcgtcctccacgatctcggcgtcgaccacgtcgtcaccgctgccgccggccgggcccgcgccggtcgcgccgcccggagcacccgtcgcaccctcggggccggcctgcggggcctcgccctgggagtagagcgccgagccggcctcctgggagacctgggacagccgctcgtgcgccgacttgatcttctcgatgtcggtgccgcccagcgcgccgcgcagctcgccgagcgcctcgccgatcttgcccttgctctcctcgggcagcttgtcgccgctctcggccaggaacttctcggtctgccactgcagctgctcggccaggttgcgggtctccgcgtcctcacgccgcttcttgtcgtcgtcggcgtgcgactcggcgtcgcgcatcatccgctcgatgtcctccttcggcagcgcggagccaccggtgatggtcatcttctgctccttgccggtgcccagatccttggcggacacgtgcacgatgccgttcgcgtcgatgtcgaaggacacctcgatctgcgggacgccgcgcggggccggcgcgatgccggacagctcgaaggtgccgagcttcttgttgtacgccgccatctcgcgctcaccctggtagacctggatcagcacggagggctggttgtcgtccgcggtggtgtagacctcggagcggtgcgccgggatggtggtgttgcgctccaccagcttgtgcatgatgccgcccttggtctcgatgcccagcgacagcggggtgacatcgagcagcaggacgtccttgacctcgcccttgagtacgccggcctgcagcgcggcgccgaccgcgacgacctcgtccgggttgacgcccttgttcggctcccggccgatcaggctctgcaccagctcggtgacggccggcatccgggtcgagccgccgaccaggatgacgtggtcgatgtcggagagcttgacgtcggcgtccttgatcgccgactcgaacggacccttgcagcggtccagcaggtcctgcgtcatgcgctggaactcggcccggctcagggacatgtccaggtgcagcgggccgttcgccccggccgtgatgtacggcaggttgatgctggtggtggtggccgcggacagctcgatcttggccttctcggcggcctcgcgcagacgctgcagggccatcttgtcctgggacaggtcgatgccgtgctcgccgcggaacgtcttcaccaggtggtcgatgatccgctggtcccagtcgtcgccgcccaggtggttgtcaccggaggtggacttgacctcgatgacgccgtcgcccagctccagcagcgagacgtcgaaggtgccgccgccgaggtcgaaaaccaggacggtctgctccttggagcccttgtccagcccgtacgccagcgcggcggcggtgggctcgttgacgatccgcaggacgttgaggccggcgatctcaccggcctccttggtggcctggcgctgggcgtcgttgaagtacgccgggacggtgatcaccgcgtcggtgatggtctcgcccaggtacgcctcggagtcgcgcttgagcttcatcagcacccgcgccgagatctcctgcggggtgtacttcttaccgtcgatgtcgatcgaccagttggtgccgatctcccgcttcaccgaacggatggtccggtccgggttggtcaccgcctggcgcttggcgacctcgccgaccagcacctcgccgttccgggcgaaggccacgatcgacggcgtcgtccgggagccctccgcgttggcgatgacggtgggctcgcctccttccagaacgctgacgcaggagttcgtggtgccgaggtcgatgccgaccgcacgtgccatggtgttcctcgcttcgttaccggctgtgtcgtacgaaggtgagtccgtacagggttgagtgggaccgactcaatgatgccacgggtccgccaaccgtcaaagcgaagttgagccggagtgacgcaagtcgagcgctgcgggctcgtaccgcggtacataacctctatacctgtccggtcacggcataccggtatccgttgctcgccctggatagatcgtgcacgctttatccgtgacgacgcgcggtgaggcgggagggcttcgggccacatccgccgaccccgccgtaacaagcaacaagaaccaggtcaacacggctgccgaaggcgccggcccggcgcgagcagacattgttgatcgtacggggtacggcatggcccgtcccgcgaacaaggagaacggcatcaccacaccggtcagccccccacccgccgtgggcaggctcgcgtcggccctgcgccgactgcgcgcggccctcggcacggtgtcgtacccgctggtgctgccctccgccgaggaggcccgccgggtcggcaccgcgctgctcgcccaactcgacgactatctggtcccgcggctgtcccggctggacgcgcccctgctcgtggtggtcggcggctccaccggcgccggcaagtcgacgctggtcaacagcctggtgcaggagcgggtgaccagcgccggggtgctgcgcccgaccacccgctcgccggtgctcgtcgcgcacccggagaacctgggctggttcgagcagccgcatctgctgcccggcctgatccgcacggtcaagaccagcgacgacccgaattcgttgcaggtgatcggcgcccgcgggatcgggcccggcctggccctgctggacgcgccggacgtcgactcggtggtcgaccacaaccgtaagctcgccgcccagctgctggccgcggccgacctgtggctgttcgtcaccaccgccgcgcgctacgccgacgcggtcccgtgggagctgctcaagacggcccggttgcgcggcacggtgatcgcgctggtgctggaccgggtgccgctggacgcggccgccgagatctccgcgcacctgggcgagatgctgaccgagcacgacctgggcaacgcaccgctgttcgtgctgccggaaagtcagctggacgagcgaggcatgctcccgcatccggcgatccagccgatccagcagtggttcgcgcagctctcggccgacccgcgggcccgcgacgcggtggtccggcagaccctggacggcgcgctggccgcgctcgccccggcgatcgagggcctggccgaggcggccgaggagcaggtccggacggcgcaggcgctggacgagcgggtcgagtcggcctatcggacggcccgccggacgatcgccgagggtctgcaggacgggcggctgctccgcggcgaggtgctggcccgctggcaggagttcatcggcaccggcgagctcgtgcgcaacctggagtcccgcgtcgggcacctgcgcgaccggctggtcgcggcggtcaccggccggcccgagcccagccgcaacctgcaggtggcgctggagtcacagctggtcacgctgctgcgcggggtggcgaccgacgccgccgagcaggcctacgccgcctggcaggcgcacccggccggggaggcgctgctgctgcccgagctgaagacggcctccgacgggctcgcgctgcgcgccgaccggatggtccgggactggcagaaatgggtgctcgacctggtccgccgggagggcggcgacaagcgctcggtggcccgcggcgcggcgtacgcggtgaacggcgccggcctggccgtgatgatcgccgtgttcacctcgaccgccttcatcccgaccgggctggaggtcgcggtcggggccggcaccacggtcgccgcacagaaggtgctcgaggcggtcttcggtgaccaggccatccgcagtctggccacccgggcccgcaccgagctggtcgcccgcttcgacgagctgctcaccgccgaagcggcccggttcgccgaccgcaccgctatcgtgcgccgcgaggccgaacccggcacactgttgcgccgagccgccgctgaggtggagagcgccaggaaggacatcgcgttgaccggatcggggtcatgagtctggtggagaacgtgcgcgacaccggtcgggtggacgccgagagcctgacccgccggttggaggcgctgtcgaggttcctgcggctggtcgatccgtacctgccggacagcgagctggtcaccgcgcacaccgtggtggaacgggccagcgggcggctcacgctgtcgctggaccacaccgtggtggcgctcgccggcagcaccggcagcggcaagtccagcctgttcaacgcgctggcccggttcaagctgtccccggtcggggtgcgccggccgaccaccggcaccgcgcacgccgtggtctggggcccgctggagccggccagccggctgctcgactgggtcggcgtgctgccccggcagcggttcgtccgggagagcgcgctggacggtgacgacgaggcctcgctgcgcggcctggtcctgctcgacctgcccgacttcgactcgatcgagcaggcccaccagctggaggtggaccggctactcggcctggtcgaccagatcgtctgggtggtcgacccgcagaagtacggcgaccggatcctgcaccgggcctacctctcccagttcaacacgcacgccggcgtgaccatcgtggtgctcaaccaggccgaccggctcagcgccccggacaccgaggcggtgctcaccgacctgcgccggctgctcgacgacgacgggctgtccggcgcgccggtgctggccacctcggcgaagcagcccgggatgctgaacgagctgcgcagcgcgctggagggcacggtggccggccggcaggccgcgctgcgccggctcgccgccgacgtcgacgtggccggcgaggagctggccgcgatgatgggaccgccggccgccgaggacgaggtcgaccgagccaccgtccggcagctgaccgacctagctagctagggtgccggcggtggccgacgccgcggccgcgtcctaccggctgcgggccgccgcggccaccggctggcccgctggtccgcggcctgcgccggttgcgcccggacccgctgcgcaagctgcacctgggtgagccggtgaaaaccgacggggtctccaccgacgtggtgccgcgcacctcgctgccggaggcggacgccgcgcagaaatccgcggtcgggctctcggtgcgcaccgtcgccaaacgcgccgccgccccgctgcccgaggtctgggcgccggcgctgaacaccgcggcgcgctccaaggcggccgacctgccggacgcgctggaccgcgcgatcgccaccaccgatctcggcaccgagcaccggccggcctggtggcgactggtcggcgggctgcagtgggtgctgctggccgccgccacggccgggctgctctggctgatcctgggctacgtgatgagcgccctcaaactgccggacatcgacggaccgcacgtcggctcggtgccgctggccaccgtgctgctgctcggcggcctgttcgccgggctgctgctctggctgctgctgaaacccgtggtcgaggcgggcgggcggcgggcccggcggcaggccgagcagaagttgcgcgccgcggtgaccgacgtcggccgccagtacgtggtggccccggtccgcgaggtgctcaatgcctacgcgcaggcgcgcgaggcgctcggcgtggtgcgttcggagtagtccgacggcatgccgcgagcggtaggctcgcggcatgccggcaccccagagtgtgtacgaggcggtgctgcacgcggcccgcgacgttctccagctgagttgtgcgctggatgccgagatgctcggagcagcgctgctgggcagtatctacgcgatggccgagggcgaccgggcggccgccgtccaggagttcgtcggcgagttcctgagcgcgaccgaccggcgcgccgagccgttcgccgaggcgatccgcgaggtcttcgcgaccctggtgccggcggccgacggcgcggaccgggtcggtcccggccggcaggccccggcctgggccggtcagctcggccgggtgcacgtcaccggctgctacgcctacggcgacgtctacggcgaccagacctcctacctggtgacgtacgcgtatgacgacaccgacgacggcggtcccgagcacgccctggtcgcgctggtcgaccacaacatcggcatcgtcaaggacgtgttcgtggcgagctcggcggagatcctcacccaggtccgcacggtctgcgagcacgacgagctgacctggttccgggacgaggacccgggccgggcccgcgacgaggtgggccggcatctgcgggtcaccgacgagctgggcgagctgcccgccgacggttcgctggccaccgaccgggccctggtcggcgcccggctggcggtgctgcccgaggtcaccaccccgccgctggacgagcccgacccgccgaaggtgccggagctgatccacgacttcctggcctcgccggaggccgcccgggaggggctgaccggcccggacaccgaccagccgtccctgcagttctgcctgggcctgctcgtcgaccacgcggcctcgctgtccagcggtgacccgctgcgctggagcccggcggtggccggcttcttcctgctggactgggtgcaccggcgggcggtgctggacatcgacgacgccgcgatgctgccccgggtggtccgcgcctggtcggcctacgccacctggcggcgcgggctgcccccggccgcggtcgcggagaccgccgccgaggtggagaaactggtgccggagttcgcccggctgtactcgaccggggagcgacgcagcccggcgaccgcggcggtcgcccagctgatcgccgagggtgtcgacccgagcgacgacagcgccatcgacgcctggctgcaggccaaccgcgaccggctgggcgacgactgagcctgcgccgctccgggagccaagctaccggtggttggcgtggtgctcgccggtgatgtgctcccggtggtgccggccgacccgggagctgcgctgacgggccgggttgttctcgtcgtgcagggtgtgctcggcgcggtggtggccgcggtacgggcggttggagttgcgggcctcgtcggagcggggctgggccatcgcgttgcggacgttgcggccgctgcccccgtagctgtactcgatgatccgcgcggcgttgacgttgtgcgggcgttcggtcacggtcgacctccggctggtgggggaccagccgcggggccggtcgctgatgatgtctggctcgcacctgtgatgcggggcgtcctggtccggctcatcggcgtcgtcgtcaccgtcgtccgtggaatcggcgtcatctgaagaatccggttcgtccgatgcggtgctgtcgcttccggacagatcgccggatgccggctcgtcgaatcccggatcgtcgggggcgggatcgtcggacggcagcgcgcgccggccgagcgggccgggccagtcgtcgtcgggcacctcgggcaggccgggcaccgtcgggatcacccgggccggccgggacaccccgtggtcggcgggcgggcgcgtccgatgcggacggggcggggctagctagctagcccgcggcagcccgggaacggtcggcagggtcgccgggtcgcgaccggggggcggcgacacgcccggggacgcggtcgacgacgtaccggaatcgatcggcgatcgggagggcgacggaccggacggtgacgagcggaccgggccgggcgccggaggcgcgaggaagggcgcgtccatcgctccgctgcgaccgttgccggcgatctcgctggtccccgcggtgatcacggcgagggtcggcaccgaggcgaggccgaccagcatgacgaccagcaggagatagcgccgggtcggcccggacaggccgtagtcctcccggtatacaccgttgaaccgcttcctgagcaccttgaggggcggctcgtagccgtcgtcgtcgggcaggtgcggcacgccggtgtccctttcgaaccaaagatcatcctggatcggcctcggtcacaggggtgaacgacccatggctcgttcgggagcggcaagttcggaccattcgtaccgtagtgatgacccaaaaaccactaaatcgggcaaatacccttaacgatacgtcagcagaaaatctctattcgtgatccacgcactctgtaacgcgcctcactccctctgtcaggatgggggcgacggcacggccgccgtcgccttccgccgaccagcggggcagcggcgggccgtcccgatgggggcgcagtccccgccggaacgtcgcgcggcagcctcacccggcacatgcgcggcacccagtggtccgccgcgtggccgggcgacacccgccgcgggcgctagagagatacagggagacacggatggcgaaaggcgaacgcaaagccggtggcggcagcgacgccccggcgggcggcttcgtccagctactcacgcccgacggcgagcacctcggcagcgtcaccacggcggacggcgccacctactcggtcgacttcaccgacgacgagtatcgcggcctctaccgcgacctggtgacggtccgccggctcgacgccgaggcgaccgccctgcagcggcagggcgagctcgggctctgggccagcctgctgggtcaggaggccgctcaggtcggctccggccgggcgctgcgcccgcaggacatggcgttccccacctaccgcgagcacggcgtgctgtactgccgcgggatcgacccgatcatgccgttcggcctgttccgcggcgtcgatcagggcggatgggactcgaacgagcacaagttcaacagctacaccatcgtgatcggctcgcagacgctgcacgcgaccggttacgccatgggcgtcaccatggacggcaagaccggcagcgccgacggcgaggccgtcatcgcgtacttcggcgacggcgcgaccagccagggcgaggtcaacgaggcgttcgtctggtccggggtgttcaacgccccgatcgtcttcttctgccagaacaaccagtacgcgatctccgagccgctggagcggcagacccgcatcccgctgtaccggcgcgccgccggctacggattcccgggcatccggatcgacggcaacgacgtgctggcgacgtacgcggtgaccagggccgcgctggacaacgcgcgcaacggccagggcccgaccctgatcgaggcgtacacctaccggatgggcgcgcacaccagctccgacgaccccacccgctaccggatcgcctccgaggtcgagtcgtggaaggcgaaggatccgatctcccgggtcgccgcgttcctggccaagcagaaactggccgacgacgacttcttcgccgaggtcgacgccaccgccggcaaactcgccctggacctgcgggaacgggtgctggcgatgcctgatccacaaccggtcacgatgttcgacaacgtctatcccaccggctccccggagctcgaccggcagcgcgccgcgttcaccgggtaccacgcgtcgttcgaggggagtgggcactgatggccgagacgatcaccctgggcaaggccctcaaccacggcctgcgccgcgccctggagaacgacccgaaggtcgtcatcatgggcgaggacgtcggcaagctcggcggcgtcttccggatcaccgacggtctgcagaaggacttcggcgaggaccgggtcatcgacaccccgctggccgaagccggcatcgtcggcaccgcggtcggcctggccatccgcggataccggccggtctgcgagatccagttcgacgggttcgtcttcccggcgtacaaccagatcgtcgcccaggtggcgaagatgttctaccgctccaagggcaaggtccgggtgccgatggtgatccggatcccgttcggcggcggaatcggcgcggtcgagcaccactccgagtcgcccgaggcgtacttctcgcacacccccggtctcaaggtcgtcagctgctccaacccggccgacgcctactcgatgatccagcaggcgatcgcctccgacgacccggtcgtcttcttcgagccgaagcgccgctactgggagaaaggcgaggtcgacctcgacgcgccgctgagcggcgcacacccgctgcactcggcgcggatcgcccggcccggcaccgatgccacgattctggcgtacgggccgatggtgcgcgtcgcgctcgacgcggccgccgcggcggccgaggacgggcgcaacctggaggtcatcgacctgcgctcgctctccccggtcgactacccggtgctgttcgagtcggtcaagcggaccggccgcgcggtcgtggtgcacgaggcccccggcaacatcggcctcggcgccgagctcgccgcccgggtcaccgaggagtgcttctactccctggaggccccggtcctgcgggtgaccggctacgacatcccgtacccggcggcccgctcggaggaggagtaccttcccgatctggaccggctgctcgacgccgtcgaccgctccttcggctggtgaccgcgatgtcccggatcaaggaattcaacctgcccgacctgggcgaggggctgaccgagggcgagatcctcgcctggctcgtcaaggtcggcgacacgatcgagctgaaccagccgatcgtcgaggtggagacggcgaaggcggccgtggagatcccggcgaagtgggccggggtggtcacccggatcttccacgaggcggggaccaccgtggaggtgggccagccgatcatctcgatcgacaccgacccgggagccggggatcttcccgccactcccgagccggcggcggctccggccgcggcgacgccgcacggcgggggccgcactccggtgctggtcgggtacggggtgcgggagagcagcgcgaagcggcgaccccggatcagtgcgccggccgcatccgcaccggtcatcccggccgctccggtcgcggctccggctccggtcgccccggttgctccggtcgctcaggcggctgcggtcgcggtgcctgttcgcagtgggccggtgctggccaagccgccggtgcgcaagctcgccaaggacctgggggtggacctcgccaccctcaccgggtccgggccactggggtcgatcacgcgggacgacgtacacaaggcgctggaaatgccggcgcagccggtgagcgtgctgaacggcgaccgcgagcagcgcatcccggtcaagggcgtacgcaagctgaccgcggagaacatggtggcctcggcgttcaccgcgccgcacgtcaccgagttcctcaccgtcgacgtgacccgcagcatgaaggcgctggagaagctgaaggcccggcgcgacttcgccgacctgcgcgtctccccgctgctgctggtggccaaggcggtgctgctcgcggtcaagcggtatccgatggtcaactcgtcctggtcggcggccggcccctcaacggccgagatcgtggtcaaggactacgtgaacctgggtatcgccgcggccaccgagcgcgggctgatcgtgccgaacatcaaggatgccggccgtctcactctgcgggagcttgccgaatctctcaacgagctcgtccggacggccaagtcgggtaggacgtcgccggccgacatggcgcacggcactctctcgatcaccaacgtgggcgtgttcggcgtcgacaccgggaccccgatcctgccccccggcgaatcggcgatcctggccttcggcgcgatccggccgacgccgtgggtgcacaagggcaagatcaaggtgcgccaggtcaccaccctcgggctctccttcgaccaccggatcatcgacggcgagctgggctcgaagttcctccgggacatcggcgagttcctcaccgacccggaagccgccctgctggcttggacttaaggtttcttcggtagtaacccgggtgcaaccttcgatcgttaggcgaatgaccgggatcaccatctaaatagttggcatggtccaccgtggaggcggacactggaggcacaccaaggacgtgcgccgacggtgtccgccacaagcggacccgcagctcacgtcgagatatcgggagcaccagccatgagcatgatcaaccgcatccgccagcgtcgtctcgtcaagcgcgaggaccgggccctcgaccgggcctggcaggccgcgcccactccggccatgcgtcacgagatcaacatcttcgcctcgcaccgtcagcccctttaggtcacggcgcccaccgtccggcccgcccgcatcacccgggcgggctgtttcgtatcggcgaccgtgccgacaccccgcgtggctttccctcaggggcgtacaccgggattttctatgccgggaacgcccggtacggtggggcactggtcctcaacccggcgcggccggccggggtggtgaccggggctctcgacggtgccccagcacggccaggcctggaagctggcacgacccctggcggaaggtcgccggaggggtcgcgtccgtgcaaagctggcacggccgcatcgatgaggaggcgcgtatgacgtccgaggggcaccacgccgggcagccggccgaggccgcgtcgggcggacccgattccgagggtcagcgagtttcaggccgggcatccgccccggcccccgccgaaggcactcccacgtcgtacggtccaccaccgcaaaccgcgcccggcggcggctcgccgttcgtggtgccggcggtcgccaccttcggctccggatccaacccgaccggcaccccctacggatcggcgcgaacgccccagggcgaagaggcatcgccgtacggatcggtctcccccggagcggctcccacctacggttcaggccccgccggggacagcccgtgggctcccccgcagccgccgaccacggccagcggactgcccacccggaccccgggcgcctcggccgccgcggccgaccagtccaccttctccgccttcggcgagcagaaggcgcgcgtgcccggcgccaccctcaccgacctgccgggctccggcaccggtcgtcccggctctccggattccggcgtcggtcgccccggcctcaccgggccggccgagaacagctggctcggcagtgccgcccgccccgccggggagagcgcgccgaccgccaacacgttccccacccggcagggcgacagcggcggattcccgacccgggcgcccgccggaccgaccgcggccgaggagcccagcggcccgacgcccaacctcgacctgcccatccgcagcaccgcgggacatgccgcgccgccgtcgccgttcggcgccgaggccgagcaggcttccggattcccgcagcgggtgcccggcgcggcgctcggcagtggggggtcactgtcggccaacccgccggctgcggcggtgcccgcgccggccgctccggcgttcccgcctccgtcgtccagcttccagccgtccggcggggcgggcttcccgccggccggggcggcttcgacgcccggatcgggcttcgcatccgggcccgggtccgctgctgttcccggctccgcccccgtgccgacggcttcggcatccggggcggttccgcagcctcgggatgccggtgccgcccggccggtgaccggctcggctcggccggcgaccgccagcgtctcggtgcccggcatggtgcagccgccggccgacggcgcggagatcccaccggccggcgcggcgccgcaggcccgggtctacgggcgtgccgccgcggcggaggaggcttcgcccctcggctctacgccgttcccgggcgcgcgcgtgcccgacaacgggggccagaccagtccgttcgcgccggagagtcccttcgcccccgacagcggtggccagggcagtcccttcgcccctgacagcggcgtccagggcagtcccttcgcgcccgacaacggtggacaagccagcccgtttgcgcccgccggcgaccggcagagcaacccgttcggttcggacaacgagcggcagaacagcccgttcgcgcccgacaacggccggcaggccgacccgttcgcgcaggacgccggtcggcagacggacccgttcgcgcagggcccggagaattcgggcgggtcgttcggggcccggtccgagggcttcggctcgttcgcgccgacgcagcgcgccgaggagaattcgggcggcttcggggcattcccgccgccgcagcgcggtgaggagagctccggtggattcggcgggttcccgccgccgcagggcgagacctccggcgcggccccgcaatcgccggctcgggccaccgcccgcgcttcggcgagcgcccgcgtcaccccgccggagcaggcttcgtccggcggtcccggctccggcattcccgctgctccgggctccggcggcccggggtccggtccggccggttcccccggctccgggattccctcgtccacaccggggtccggcgtctacggctcccccggctcccactccggtcccgagtccggcgtctacggctccgccggggccggctcggagtccggcgtctacgggtctcccgggtccgcgcccgagtcgggtgtctatggcgcccccggcgcacccggtgtgccgccggccggcccgacctccggcagcgcccgggtctcgcagccggacgccaccgcgccgttcccgggttctcctgccgcgttctccagcggtccgggcggtccgggcaccgcgcccggcttcccgccgccgtccttcggtggcaccgctccggcttcgccgccgttcggtggcaacccgccgggctcgcccttcggcgggaacgccccggcggcacccccgagcggctccgccccggcgacgccgctcagcggcaacgccccgccggtacctttcggtgggaaccctccgacggctccgttcggcgacaatccggcgacggtaccgttcggcggccatcacccggggtcgccgttcggcagcgccgcaccggcttcaccgccgttcggcggcaccgcaccggcctcttcgccgttcggtgaacggccccagcgcccgcagttcgagggcatcaacgagccgaccttcccgccgccgtcgtcctccttcccgggtgcgccgagtgcctccggcgccccggcgaccttccccggcgcgccggcccagccgggcacctacggctccgcgccgcagaacgctccggcctggggccaaccggctaccggcggcgaccagttcagcgagcacacgacggatgtctccggccggggcaactccccgttcgacgctccgccgatgccgccgggccagggctcggcccacccgttcggcgaccggtcgatgccggccggcccggtctccggcgacccgttcggcgctgacccggccgcccgcgccacggtgaccccgccggttccggaggacaccacgagctggccggccacgaccgagcagggcaagttcgaccagttcaagcccgaagccgcacccgcgcccaccccggcgaaggtgcgcaccatcccggtcgccctggccgtggtggtcggtgccgcgctgctgctcggcatcgtcttcggcctggtctacctgatctccgggggcggtggcggcagcttcagcgccaacgccggcgactgcgtgaagaacggcgacaaggtggtcaaggtcgcctgctcggagccgggcgcctaccagatcaagcaggtcgtcgacgccaaggagcagtgcgccgacaaggcgcagccctacgtcgtcgccgacaagaaggtgtactgcctggtcaagccggctggctgagcccggcacccccgccgggtcggcaccagcccgacccggccgccgacaccgccgcggcatgtgacgcgcgtccctgaccggccccggccggtcggggaagccgctgaggcacgatgggcggatgaattctcgcgttcgtgcgcccgaactcaagggtcgcggctggctgaacaccggtgggaaggccctcaccctggccgacctccgcggcaagatcttgattctcgatttctggacgttctgctgcatcaactgcctgcacgtcctggacgagctgcggccgctggaggagaagtacggcgacgccctggtggtgatcggcgtgcactccccgaaattcgagcacgagcgtgatccccgggcgctggccgccgccgtcgagcggtacggcgtgcaccacccggtcgtcgacgacggcgacatgcacctctggcagcagtacgccgcgaaggcctggcccaccctggccgtggtggacccgaccggttacctggtcgcctcgatggccggcgaggggcacgccgagggcctgtcccggctgatcgacgagctggtcgccaagcatggggcggacggcaccctgcaccgcggggacggcccgttcgtgccgccgcccgcgccggccggtctgctgcacttcccgggtaaggccatcgagctgcccggcggcaatctgctggtctccgattcggcccggcattccgtggtggagctgactccggacggtgcgacgctggtccgccggttcggcggcccgggccggggtgagccgttcagcgagccgcagggcctggtgctgctccccgccgaggtccgtgagctggccggttacgacgtggtggtcgccgacacggtcaaccatcagttgcgcgcgctgaacctgtcgaccggcgaggtcaccctggtggccggttccggccggccgtggcggtcggctgtggacgatcatgcccatgacgcgctggccaccgatctgtcgtcgccgtgggatctggcctggttcgacgacaaggtgatcatcgcgatggccgggatccaccagttgtggtggttcgacccgatcaagcgcacggtgggtgtctacgccggcaccacggtcgaggcgttgcgggacggcccactgccggatgtctggatggcgcagccgagcggcctgtcggtgcacggcgaccggctctggatcgccgacagcgagacgtcggcgctgcggttcgtcgaggacggcgtgctgcacaccgcggtcggccagggcctgttcgatttcggtcacgtggacggtccggccggggccgcgctgttccagcacccgctcggggtcgcggcgctggcggacggctcggtgctggtggccgacacgtacaacggcgccgtccgtcgtttcgatcccgcgtcgaacgaggtgtccacggtggatgccggtctggccgagccgagtgacgtcctggtcaccgcggccggcgaggtgctggtcgtggagtcggccgcgcaccggctggtccggctggcacccggcgtgctgcagaccgggcggacggtcgacggcgagcggcaccggaccgagcgaccgccgtcgcatctggctccgggcgaggtcaccctggacgtgatcttcacgccggcgccgggccagaaactggacagccagttcggctcgccggtccggttgaccgtgtcggcgtcccccgcggagctgctgctcgacggcgcgggtgtcaccaccgagttgtcccgtcgcctggtgctgaacccggcggtgcccaagggcgtgctgcaggtggtggcccaggcggcgacgtgtgacgtcgacgccgaattcggtgcctgccacctgaccaggcaggactggggtgtcccgatcgtggtcgaccccgccgccccggaccgtctgccgctgatcctgcgggggctggacgagtccgcgtgaaccctttcccggtgagtgacggataacgatcgacactcaacgggaggacggttcatgcaagtcagcgaaccggatgacgccgcgatcatcctccggtcccatcgggctccggaggagttcgcggcgctcttcgatcggcacgcgccgcacatccatcgctatctggcccgccggctcggcgatcaggtggccgacgacctggtcgccgagacgttcctgaccgcgttccggcggcgtgacaccttctggccgggtccgcacgacgcccggccgtggctctacggcatcgccaccaatctggtcgcccagcatcgccgcgacgaggcccgcgcgctgcgcctgcggcacgccgtcgcccccgacccggacagcttctgccatgccgaccaggtggccgcggacgtcaccgccgccgcgctgcgcgacgcgctgaccgcggctctggcgacgctcgccgacggcgaccgcgacgtgctcctgctgatcgctcaggaggaattgacgtacgagcaggtcgccgttgccctggacatcccggtgggcaccgtgcgctcccggttgcaccgcgcgcgtaccgcattgaaggccgcgctcggcggccacaatccattgaccttcgtcgaggaggaggttcgccatggatgagatcaccctgaccggggagctgggccgcgaggtgccgctgcccacggccgccgacctggcgccggctcgcgcccggttgctggccgaactgaccgccgccgcgccgccggtccgcaacgtccggaagctgcgcctccgctgggcggccgtcgccaccggcacggtcgctgccgctgccgctgccgccggcatcgttgcgatcgcccccggtacgccgtcgagcacctccgccccgcctgcccccgccgccccggtcccggtcgcgcagttcctggacgacgcggcgaccgtggccggccagggccgggacgtggtgccccgcggcgaccagttcctctacacccgggtgcgggcgaccgacgggacctggaccgactactggtcctcgatcgacggccggcacctcggcgaggagcggtcctcgtccggcaagaagacgatcatcgcggcgtgtgtgaacgggaagagctacgacccgagcgacccggtcgacgtcggttgtgagccgacccgcctctacctgccggatctgcccaccgacccggagcggatggtggcctggctgaaggcgcggaacccgggtctcgacggcgcaccgtacaacgccaacggggtggccaaggagatctggtcgctgagtgacagttactggctgcgcccggcgcagcgtgcggcgctgtaccgcgcgctcggccggttcgacgggatcagcctggtgccgggggccaaggacgggaccgggcaggtcggcaccggggtctcctggatctcaccgggcgacacggcaccccgggtgatgtgggtcttcgatccgaagcggcacgtactgctgggttaccagaacgcctcgatcgacgcgtacgcgttggtggaccggatcggtgccacgcactgacacggcagcgggccggcgggtcagcggctgaacgggcgtaccgccacatcggcggtctgcagcccggcgcgcaccgcacgggcgagatcaaccgcgcccggggtgtcgccgtgcacgcagatcgagcgcaccgcgcaccggatgggcgtgccgtcggcggcgatcacctcgccggcggcgaccatccgggtggcccgctcgacgaccgcggccgggtcgtgcaccagcgcgtccggccgggagcgcggcaccaggcgcccgtccggcaggtagccgcggtcggcgaagccctcgccgaccgcggtcagcccggcggcgacggcctgccggaacagcaccgacccgggctggcagagcaccggcagcgccgggtcgtaggcgaggatggcggccaccaccgcgtcggcctgcccccggtcgacggccgcggtgttgtagagcgcgccgtgcggcttcacgtatcggatccggtcaccggcaaccttgcagaacgcttccagcgccccgatctggtagagcacgtcgtcgcgcagctcgccgaactcgtagtcgatccggcgccggccgaacccggccaggtcgcggtagccgacctgggcgccgatcgccaccccgcgctcggcggcggcccggcacacccggtgcatcgtggaggggtcgccggcgtgaaagccgcaggccacgttcgccgaggtgacgacatcgagcagggcctcatcgtcgccgagccgccaggcgccgaagccctcgccgaggtccgcgttgagatcaaccgccgtcatggagaaatcatcgtccatcgcgaaccgtatgcggcatcactacccgtcggtaacctacgctgccgtaacctggatctcgtgacgacctctgccccgttccggatgaagccgaccgacctcggcaagccgcgactacgcggccggttgcatcagtacgcgttcttcgtcgccgccgtctgcggcatcgtgctctgctcgatcgcgctgagccgccccgggtgggggccgttcgtcagctgcctgatctacagcgtgacggtgtgcggcctgttcggcaccagcgccctctatcaccggcgggtctggagcgaacgcggctaccagatcatgcgccggatggatcactcgatgatcttcatcttcatcgccggcacctacacgccgttctgcgtggagttgctcggcaggtccaaggccgagctgatgctgggcctggtctggggcggcgccctgggtggcgtggccctgaagatgatctggccgcacctgccgcgctgggccggcgccccgctctacgtcgcgctcggctgggccgcggtcgcgatcctgccggacgtgctgcacggcggcgtgacctgcctggtgctgctgatcgcgggcggtctgatctacacggtcggcgcggtgttctacgccctgcgccggcccaatccgtggccgaccgttttcggtcaccacgagttcttccacgcctgcacgctggtcgccgcgatctgtcaccacatcgccatctatttcgccctgtacaagtagtggcctggcggatcgcccgccaggccactctttctcaggttcagctgtacgccggcggcgggggcggcgggacgtcgtcctggcgcacctcgcggtactcactggcgtagccggggccggccaccggggcgccggtggtgcgggtgaccacggtgcggcggcggctgttccagaaccacagggtggtgaccaggccgaccaggccggccgccatcaggatccagccgatcacgctgatgtcgaggccgctgatgtccgcgttgacggcgaacgccaggatcgcccccagagcgagcaggaagatgcttgcgccgatgcccatcgggccctcctcggaaagcggccgggctggctggctcgaccatcctgaatacgtcgatcgaggccatacccatacgcgtgaagttccaatcaggcaagctgtccgcatgaccttgcggacgctgatcctgctacgccacgccaaagcggagactcccggcgagattgctgatttcgaccggagcctgaccgatcggggcatgtcggacgcggacgcggccgggtcctggttggtggatgagcgcctgcaccccgacctggtgctctgctcaccggccaggcggacccggcagacctggcaggccgcatcgctcgcactggcccagggaaactcgtcgcacggcgcgctctcgcccgaggtgcactacgaggaccagctctactatggcgggcggaccgaggtcttcgacctgctccgggcggtttcggacacggtccggacgatcctgctggtcggccacaaccccacagtgtccgaagtgtccgctctgctggtcccggacgaccagtgggacggtgtcacggtcgagctgaagacctcggggctggcggtacacaccggcgaggtgccctgggcgtcgtcgtcgccgggtgggatgcggctggcccggcggcacaccgcacggggatgacatcaataaaggccggcggacgccattgtccgccggcctctatctttttcaggagagtgggaaaggtctcaggtcagaacacgtcctcggacaggtccatgaggtcgagggtggtgttctcgatgatccggcggtccgagccgatccggggcaggatctcgcgggtgaagaagcgggccgcggccaccttgccggtgtagaagttcttgtcggcctcggagacctcgccgttcagcgcgttcagcgccacctcggcctggcgcagcagcagccaggcgaggatcacgtcgccgagggcgagcaggatccggcgcgaggtcagaccgatcttgtagagctcgcgcgtctcgccgccctgcaccgcggagagccagcccagcgccgtcccgaggatctgctgcatctcgccgagggccttgcccagcgcgagccgctcgtccttgagctgaccgttgccggcctcggtctcgatgaaggtctggatctcggtggcgatggtgccgagcgcccggccgttgtccttgacgatcttgcggaagatcaggtcgaggctctggatcgcggtggtgccctcgtacagggtgtcgatcttcgcgtcccggacgtactgctccagcgggtagtcctggaggaagccggagccaccgaaggtctgcagcgactcgtggccgagcagctcgtacgcccgctcggagccgacgcccttgaccagcggcagcaggaagtcgttgatcttactcgcgatcttcgcggccttctcgtcgccggccgcctcggcgatcgcgaccttgtcctgccacgacgcggtgtagatgaccagcgcgcgcagggcctcggagtacgacttctgcagcatcagcgagcggcgcacgtccgggtggtgggtgatggtcacccgcggagccgccttgtcaccgttggagaccaggtcggcgccctggacgcggttcttcgcgtactccagcgcgttcaggtagccggtcgacagggtggcgatcgccttggtgccgaccatcatccgggcgtactcgatgatcatgaacatctgacggatgccgtcgtgcttgtcgcccagcagccagcccttggccggggtgccgtgctcgccgaaggtcatctcacaggtgttggagaccttgaggcccatcttgtgctcgacgttcgtggcgtacacgccgttgcgctcgcccagctcgccggtctgcgggtcgaagtggaacttcggcacgatgaacagcgacagacccttggtgcccgggccgcccacgccctcgacgcccaccgggcgggccaggacgtagtggatgatgttgtcgctcaggtcgtgctcacccgaggtgatgaagcgcttgacgccctcgatgtgccacgagccgtccggctgcgggatcgcccgggtgcggccggcgccgacgtccgaaccggcgtccggctcggtcagcaccatggtggagccccactgcttctcgacgaagagcttggcccactcctgctgctccggcgtgccctcggtgtgcgccacgtgggcgaacgacgggccggacgcgtacatccagatcggcgcgttggaaccgaggatctgctcggccagcgcccaccacagggtgcgcggggcgaacgtgccgcccagcgtgccgggcaggtccagccgccagaactcggaggccatgaaggtctcgtacgacttcttgaaggactccggcagcggcgcggtgtgcgtcgccgggtcgaataccggagggttccggtcggcgtccgcgtagctggccgcgaggtcctcgcgggccagccggttcacctcggcgaggacgtcacgagccgtctccgcgtcgatctcgtcgaacggcgcctgaccgaacgccttgtccgctccgaagacctcgaacaggttgaactggaggtcccgaaggttgctctggtagtgagtcatggtgtttggcccgctctccgaacgcgagttacccgtcagtaactagcactgtattactcatcggtaggcagcgacaacccgggtagggttcgttatccaagtcacctggtaggggaagctgtccgtcggatcgtgggccaaacgtctccgatcaggtggtcaccagtacagccgttcggccatttgcctacttcgaccccggaaccacgtatcgcgtaccgatgaggctcgttgctccggatagacagcgaaccatcaagggggacgccatgttcgccacgatcaagagcctgattcccgagccgcgccaggccggtcagccgcgaaattacgtcggccggcaccgccagcccgagccggtcgccgcgccggccccgaccgccccaagcccggccgagcccgaggacaacaccgccgcctaactgccggcggcgccgacctcccagctcggcaccgggaccgacgcgcccgcgtccgggcccgcgtactccagcaggaccagagcgatgtcgtcctccaggcggccgcgcacccagtcgaccaacgcggtctccagggacgccagcccgtcgccgaccgtgccgtggcccagcaggcgccaggcacggtcggcggtcgggaagaactcgccctcccggcgcgcctcccccagaccgtcggtgaacagcagcagccggtcacccggctccagccgctcgacccgcgccttgacctccggcatgaacccgagcgggggtgccggcgccggcggctccagcgggatcaccagcccgcggcgcaacagcagcggtgccgggtgtccacagttgacgatggtgagcgtgccgccacgctcctcgaccagggccgcggtcacgaaatcctcgtcgcccacactgcgggccaccgcccgatccaggtcggccacgatcgccttcaactcggcacgctcgtaggcgacatgccggtacgagcccaggacgatgctggccaggcggaccgcgtccaggcccttgccccgcacgtccccgatgatgatccggaccccgtacggcgtgttcagcgcctcgtaaaggtcaccgccgatgtccgcggcggcggtcgccgagatgtagcgcccggagaccgccaaggagcccacctgcgggccgatcgggcgcaacaccgcctgctgggccaccgaggccagctgcagcagctcggcgatccggtccgactggcgctgccgcatggtggcggcggccaccgcgatcccggtcgccagcatgatgccgagcagatagaccatgacgcccggcccggcattgccggcgcgccccacgaagatcgcgccggccagggtggccgcgatcccggcgcccagcacgtactgccagacggcgaacagtgcggcggtgaccggaaccagggcgaacaggcccacgtaacccaccgtgcgggggctggccagctccacggcggacacgatcacgagcagcacgacagccgcaccgagaccggcgcggttccctgggctcatcgggcggcggcccggcacgaaggtaggcatggttccgccgaacagcatgcccgatccgggactcgtcaggcatcaagttgaccccttgtccgatcaggttctgtccggtcggtcgtcttctcctcgtgccgccggcacttctcctcgtgccgctttgacaccatgtcgtggtgaccgacgatctccgtgaccggctgcgcggcgctttccgctggaccgaccccgggccacccgccgactatctggtcagcgaccgctccggatggtggcgcgatccggtgatcctggacggactcggcccggcgctggccgatctcttccgcgccgaccggcccaccgtcgtggtgtcgcccgaagtcaccggattcctgctcggaccgctggtcgcccgggctctcggagtcggcttcgtcgaggcctaccgggccggcgcgcgccgcgccatcgccgagccgatgatctgggccgaggtcccggccgaccatcgaggtgacattcaacacttgggcgtacgacgtgagcgcctggccgtggacgaccgggtcctggtcgtggacgactgggcggccaccggctcccaggcccgcggactgcggaagctggtcggcgaccgctacatcggaaccgcggtgatcgtggacgagtgcccgcccggggtgaccgccgagctcaccatccggagtctgctcagtgcggccgatctggagcccatcgtggagtgcgacgcgccacagtcggacgcgtcgcccccgcgatgagtcagcgacttcgtccggccggaactggagcggcacggcggacgcgtcgcccccgcgatgagtcagcgccgacgctggtaaccggcgagcgcgccgcggctcgggtgccagcccaccgcggcgtaggtcgccaggccccgcaccacgtaaggatcctgcgcgagcagctcctgggcctcggcctcggtgtccacgtccagcaggatgaccccgcccaccggcggatcctgccgccccgcggtgaccgacaggccccgctcctccaggtcggtgacgaacgccatgtgctcgtcccgcgcctggtcgacctcggccagcggtttctggtacgtcgaaatcatgagatacacggcgtcatcgtagatcccggcggaccggtcagcggtgcacccgcaaaccctgggcgaaagccgccccgagcacctgctccacctgcgccggactcaggccgctggtcggcacccgcacccagcggccgccgcgcgtcccgaacatcagctggccggacagcgcctccacgctgcggaacgcccgccaggcgtacgcgtgccgaccgatctcgtcggaacgcgcgacgcccccgtcgcccgcctggggggtgccggtgccgaactggaccatccggaccgctgaggccgggcttcgctcggctcgccgtattacctggcgggcggcgtctttacctggtcggcggtgcctttacctggtgggccacgtgcggaaattcagcgccgagcggctcgcggtcgggccgcgctggccctggtagcgcgatccgtagacggccgaaccgtacgggtgatcggcggggctggacaggcggaagatgcacagctgcccgatcttcatacccggccagagcttgatcggaagattggccacattggagagctccagcgtgacgtgaccggagaagccgggatcgatgaaaccggccgtcgagtgcgtgagcagcccgagccggcccaggctgctcttgccctcaagccgcgccgcgagctgctgcccgagagtgatcacctcaagcgtcgacgccagcacgaactcgcctgggtgcagcacgaacggctggccgtcctcgacctcgacctcggcggtgagctcgtcctgctgctcggccggatcgatatgggtgtagaggtggttgttgaacacccggaaaaatcggtcaaggcggacgtcgatactggacggctgcatgagcgacggctcgaacggctccagcgagagatccccggctttgatttcggaaaccaggtcacggtcggagagcagcatcgcaacaccataccgagcggtacgccgcgcccctcccggcgcctcccgcccagctaccgcgttcacccgctcgcgccacccggcaggcccgccaccggcagatgccgtccaggggatttgagctgcccgaatcggtgttttcagtggccgattcgaacgcttgttcgatagaatgctcgtatggcttcctggtccgaattcgccgctgccgcgccctcgctcgcggccggcatccgtgcgctcctgcagcagtacggccccggcatgggctatctcgccacggtccgccccgacggcggcccccgcgtccacccggtctccccggtcttcgccggcagcgggctctactgcttcctggtcgactccccgaaacgccgggacctggagcgcgacccccgctacgccctgcactcctacccgccggaggagagcgacgacgaggcctacctgaccggccaggcctacccggtccacgacccccgcacgatcgccgtcatcgccgacgccctccgcgcctcccccgacgtcgactggcgcctcttcgagctgagcgtcgagtcggccaccctccgccaccacggcccggccggcgccctcccgttggccgccgccccgctgctcatcccgatcacccagaagtggaggtccccacagaagtccccccgccccctggccatggccggctgagacctccccgccgcgcggcggcgcaggagcgggccggcccacgaatccccaggtcgccccgctatccgttacgccgggggtggtgccggctgaccacagtgcggggtgcttccgccatggagccggataatcaggtacagtgaggccgcttgcgggtgtagttcaatggcagaacatcagcttcccaagctgacagcgcgggttcgattcccgtcacccgctccacgtggaaagccctggtcatgaccgctggtcctgaccagggctttcgttattccagaggcagcatcggcagccggaacgcaccgcgtcgacgtgcggcggacgggccgggccggcgggcgcgctggacgcggcaagctcgatgagggcggcccagacgcactgagggcagcaagctcgatgagggcggcccggacgcactggaggcggcggggcggcgcgggggcggcgccggggcgcgtgccgggcgggatgcgcgggctgaggcaccgccggtcaggtcgggcgcgctggagggcgggttcgaattgccgggccttggaccgggcggacggcattcgcggcatcgaggatgatgtcgtcgatgtgggcatcgacatccaccggtagctacgggccgatggtgaggaagacgttgtcgatctcgccggcgaactggtcgttgcctcgggccgggcccttgccacccacccggaggggttcggcgttggcgatcgacaggctgggcgggaccgggacggacgcgtacggggtgccgtcgacctgcagggcgagcctgccttcggtgcgactgcactcgaggtcgtgccagtgcccgtcggccacgtcgatcgggggttcggcgcggtagatgtgtgcccggttgccggtgatcacacagctggggtgcccctgccggtggtcgacctgcagcttgaactggctgacgccgccgaccgaatagcctttctggacgacgttcgcgccgtcggccagatcggcgtgggtcatcagcaccgaggcgccgtagcggagcggccggcggcccgggttgagggtgtcgtcgcgctgaccctccaggatcgcccgcgggcagtcccgttcccgggccagcgtgcaccggtccgggtaggcgacggccaggccacttccctccggtacgaggcggagctcgccgccgttctggccgagcgggcgcaattcgtggccgccgccggtgtcctcgatcggtttgccgacgccgccgtcgaagtcgtagcgcaggctgacgggggccgaggcggtctgcacccggccgaggtcggcgggcaacgggaaccgggtggcgttgggcaggacgccggccgcgggtggggtggccaggcggatcgccggaccgccgatcgccggggtgccggggcggggggccagcaggagcaggctgcccaggaggagggtggtggacagggcgccgaacgaatgggcacgccgccgggagtgatgcatggggttattgtccgcattgtcgcttgccgtccgtgccgaaactccggacatgccagagaccacccgtacgcgttcgcccgaaatgccgaacctgaacgaccccaccgtccccactcacggatcaacccgttcgcacgaaccgccacacgcgaaaccatggagggggagaaggcggccgaagagaagcggatcagcgcggccgcgccaccaccggcgccgagtgcgccgcggcatgcgaccgctccccgatcaccgcgtgcagcacgtcatccagcgtgatcaccccgagcggccgccgcccgtcgctcaccagcacgatgtgcagccgatcccgccgcatcgtcagcagcagctcggccaggctgcgctccggagccaccaccgccagcggccggatcacttccgccggaatgggcagccgccgctgcgcccccgaatacccgaggatgtctttcacgtgcacgaacccgagcacccgccgggtgtcccgctgcaccaccggaaagcgcgaccgcccactccgtgtcgccaccgcctccagcgtcgccggcgacacgtccgccgccaccgtcgtcacccgcgaccaggacagcagggtgtccgcggcggtccggttgttcagcccgagcgccgcatggatccgggcgtactgctccgagcccagcagcccctcgctgcgcgcctgggtgaccatcccggccagctcctcggcggtgaagacggtcttcaccgcgtcggtggcctcgatcttccacagccgcagcacggtccgggacgcccagcgcatcgcgatcagcagcggtttggtggccgtgcagaaggccagcatgaacgggccgaggatgagcgccgagcgttccggcccggccagcgtgatgttcttcggcaccatctcgccgaccaccgtgtgcaggaacacgacgacgaccagggcgagcacgagcgcgaccgggtgcgccgcccgctccggcaggtgaaccgtctggaaatggctctgcagcacctgggccagcgccttctcggcgatcgcgccgagggtcagcgagcagatggtgatgcccagctgcgccccggcgatcatcagcgggatctggttcatcgcggacagcgcccagcgcgcggccttggaggtggcggccagcggctcgatcgcggtgcgccgggaggcgatcagcgcgaactcgccgccgacgaaaagtccgttaccgagcagcagcagcaccgtgatcagcacgttagtcatcggccggctcctcgggcggggccacgacccggacctgttcgatccggtgccggtcgacctccatcacggtgaactcccacccgtgctcctccagcgactcaccgaccaccgggatgtgcccgagccgggccagcaggaagccggccagcgtctcgtacggcccctcgggcagcgcgaacccggtctgctccagcacctcgtcctcccgcaggaggccgtcgaccaggtaggtcttctccccgccgggggcggtcagctcggcggtgccggtctcgtcgagctcggtgtcgtactcgtcggcgatctcgccgaccagctcctcgatcaggtcctcgacggagacgacgccgtcggtgccgccgtactcgtcgaccacgatcgccaggtcggcgtccgcggcccgcagcgcggcgagcaccttgtccagaccgaggctctccggtacgtagaccggctcccgggcgagcaccgacacccgggtcgcggcgcggcgttcgggtggcacgccgagcgcgtcgttcaccccggccacgccggtcaccacgtcgagggtgttctcgtacaccggaaatcgggtgtgcccggtctcccgggccaccgtgatcaggtcggcgacgctcgccgtggttttcaaccccaccacgtcgacccgcggggtcatcgccttggccgcgcgtttctcaccgaaccggatggtgcggcgcatcagcgtcgcggtctcggtgggcagcgcgccggcccgggcgctgatcgccgcgagcagccccagctcctccggcgagcgggcgctggccagctcctcctgcggctcgacgccgatccggcggaccagccagttcgccgttccgttgagcgcggcgatcatgaacttgaagagccgggagaagccgcgcagcgggcccgcggtggccagcgcgagacccatcgggcgggccagcgcggcgttcttcggcaccagctcaccgaagagcatcgacaccagggtggcgacgaccagggcgaggacgtgcgtgacggtctccgcggcggcccccgcgaccggctccaccgccggcatgatcagccgggacagggccggctcggcgagatagccggtcagcagtgcggtcagtgtgatgccgagctgggcgccggagagctggaaagacaacgagtgcagtgcggtccggaccgtccgggcccggcggtcaccctccgcggcacgctggtcgatctccgcccggtcgacagtgaccagcccgaactcggcggccacgaaaaacgcgttgcccgccgtcagcagcgcgaaagccgccaacgggagcaccgcggtcaggagcaggccgtccatgatcgcttcacctcggtgcccattctgccggaccgggtccatccggtaccaaccgtggtggtcagtcggcttatcgaccgtttgtcaccacggccgcggcggccggttcgtcaggaaccggccgccgcggcacgacgtaccgagtaatcgggtcttttaagcttcctgcttgagcgagcgcagcaggaccgtggccacgtcgaccacctcgacctcttcctgcttgcccttgccggtcaccccgtcgccgatcatcgtgtagcagaacgggcagcccaccgcgatcgtcttcgccccggtggccagcgcttcctcggtccgctcgacgttgatccgcttgccgatccgctcctccatccacatccgggcgccaccggcgccgcagcagaaggagcgctcggagttgcgcggcatctcgatgaggttgccggtctccccgagaacctcgcggggcgcgtcgaacacccggttgtgccggcccaggtagcacgggtcgtggtaggtgatgtcaccgtcgatcggctggaccggggtgagcttcccctccttgaccaggtgggccagcagctgcgtgtggtgtacgacctcgaccttcaggccgagctgctcgtactcgttgccgagggtgttgaagcagtgcgggcaggtggcgacgatccgcttgaccttccgatccccgaaggcctcggtgagcgtctcgacgttctgctgggcgagcatctggaagatgaactcgttgccgatccggcgagccgggtcaccggtgcaggtctcgccctcgccgaggatggcgtaattcacaccggcctcgtgcagcagcgtcgcgaccgcccgggtggtcttcttcgcccggtcctcgaacgcgccggcgcagccgacccagaacaggtaatcgaagtcctcggtctcgccgacccgcggcacctcgaagtcgaggcccttggtccagtcctcgcgggtgttctgcggggcgccccacgggttgcccttgttctccaggttgcgcagcatcacgccggcctcgctggggaacgacgactcgatcagcacctggtagcggcgcatgtcgacgatgtggtcgatgtgctcgatgtcgaccgggcactgctcgacgcaggcgccgcaggtggtgcaggaccagagcacgtccgggtcgatcacgccgttctcgtcgacgccaccgatcagcgggcggttgccctcggccagcgcgagcacgtccatgtgcgccagctgcgcctcggtcgccttctcctcgccggtcaggtccttgccgccaccggccagcaggtagggcgccttggcgtacgcgtggtcgcgcagcgacagcaccagcagcttgggcgagagcggcttggcggtgttccacgccgggcactgcgactggcagcggccgcactccgtgcaggtggagaagtccagcaggcccttccaggtgaactgctcgacctgggcgacgccgaacagatccttctccgggtcggcctcctcgaagtcgagcggcttgccctcgctcatcatcggcttcaaagcgcccaggcccgaaccggccggcttctccgggctgcgcttgaagaagatgttgaagaacgccaggaagcggtgccaggccacgcccatcgtcgggttcagcgagatggtgatcagccagcccatcgagatgagcagcttgaccagggcgacccaggtgggcgcgtcgtgccaggcgggcagcacgccgccgatcgcgtgggagagcggggcggcccaggtcgggtaggggaacgtcccgttggcgaccttgaagccccggatcaggaacccgcagaccagcacgcccacgatgatcgactcgacgaagtacgcctgccacatcgtggagccgaggaaccggctgcgcttggtggcgcccggcttgttccgctggcgcacgaggatcaggtagaggatgccgatcgtgccgaggatcccgaaccactcggtgacgaacccgaagatcgaccactcaccgatcagcggcagttcgccgtgcggggtgaccacctcccagtacgcctcgagaaccagcgacgacaggatgatgaaggagaacatcacgaaccagtgggccgcgccgatggcgctccacttcagcatccgtgtgtgcccgaccgactccctgagcagggtcttggtccgggtgcccttgtcggtgaaccgctccggggccggctggcccgatcggatcaccctggtgatggtgagaacggcgcgcaccgccagggcgacggccaccaccgtgaccgccaccgacaagacggtggcgatgatctgcgcgtagcccatgtgcgttgtgcctcctcggtcggctgggcgccagcctatgttacccatgagtaataggccggtgcggaccgcaggtcaagacttgcggaccctcagccgaaagcgcaccccacgccaggcgggggtgcgcttggtttggacgaatttcacacggacccggccgggtccctcaccgccagcgggagagaatgcccagcgaagccaccatgcacccgaaaccgaccgccaggttccagtaccgccagctctccaccgggtactgctgcgaggagaggtagtagacgaccagccaggcgatgcccacgacgatcagggccaccgccagcgccggcagccagaccgggctcggcttcttggacgccgcggtgaccgcggggcggatgtccgacggcggggtgtagaccttcttcttacgaacctgcgacttgggcacggaactctcctgagggtgagcggctccggggactccgaacgctgcccgtgacgaatactgttcgcccgctagcgtaatcaagacggcgtgcggacaggcacccgccggggcgagaaaatacccgccgtctgttcccgagggaggctggggtggcttttcgagacgcttggcgcgtggttctggggcgcgccgcgggcggccggcagaccatctggtcggtcggcgtgccgctgatcgcgctcgctgccggcctgctcttcaccacctccgcgaccaccgccgacggcaccgcgctgcgcgacgaccggcgcccgcaactggcccaggtgatcgccgacaaacgggaacggctgaccgccaccgagaaacgtgaggcggcgctgcgggccgaggtcgaccaggagaccgcccggctcgccgaggtcgacacgccggtcaaggtcgcgcggcagcaggccgacgcggtgcgcgagccggccggcttcaccgccctgcacggccccggcctcaccgtcaccctgaacgactccccgcggcgcggcaccgacttcggcgacaacgcgcccgacaacgacgatctggtcgtccaccagggcgatgtccaggccgtcgtgaacgccatgtgggccggtggcgccgaggccatgacgatcatggatgtccgtgtgatcagcaccagcgcggtacgctgtgtgggcaatacgctgctccttcacggtcaggttttctccccgcccttcaagatcaccgcaatcggcgaacccacagcgatgcatcgcgcgttggagtccgcagaaggagtcagacagttccgtgaggccgttgccgacttcggcctcggctacacggagaaaccggaaaaggacgtgacagtgcgggcgtacgacgggtcgaccgacctccgatccgcgcaggcggcccagtgacgaccccgcccgctgagcagccagccgccccggccggacgcggacgccaccgcgcacccgacgccgaggcacagaccgcatacatcccgcgcctgagcgacgcgtcgcccgacggggtgcccggcggcccgctgaccccaccggtcggcctcggcgccaacgtcagcccgagcccggcccgatcggcacgcaacccggccgcatcggacaccgcgattctcaaagccgacgccgcggctcggcagcggatcgcggcggcgcagatcccggcgcggagcacctcgcacgccgaggcgacccagacgccgcgcaccgatctagctagctagcgccggtgaccggtgccgcttcggctgcccgcccctacgagccggcgccgggcggccccgcgccgaccggcccggccacgcccggcagcccggcctacggaccgacctccggcagccgtgtgcacggatcggccacctccggcagcccggctcacggatcagctgccccggggcacggacccggcactccgggcggccctgtctccggttccccggggcacggaaccggcactccgggcggccctgtctccggttccccggccccgagcagcccggcctacggatcggccacgcccggcagcccggctcccgcgttcggcagcccggctcccgcgttcggcagtcccgcttccgtcgcacccggcagcccggtcggcggctcggcctccgtgcccgggtggacggccgacaccggcaagccgtccggcccggcctggacaccggcggccgagtcgaccgcgagcgccggctgggatgccgagcccacccgccagaccgccccggtgcccggccgccgcgacgcggacccggccgtcccggccgccggaaacccggcgatcccggccccggtcccgactgtcggcgctccggccgcggcggcccgggtggccgcctcctgggatccggaggccaccgggcggatcgagaccggccccgccgccgcgtccacgacaaccagctggccggctgcccaccaggccccggaaaccccctgggatgccactcaggcgcccgcgaccccgtcggccaccccgtgggcaccccaggccccgacgcttccccccgcggccccctccggccctccggccgccccgccggccgcggtgagtgcccccaccgcaccggtgccggccgcctctccgccgcagatgggctcaccgaacacccgctggatgagcaacgagcccaccgagatcgccccgccggtcaaccccaacccgtccgagacgcagatcatccggaccatcgacgcgcccaccggcatcctgcccaccctgtcgccggacaccccgctgcccggcaagctgaccgcgctgccgcccggcaaggcggccgccgccgcccgggacgccgccggtccggaggtcgcgctgggcgccgcctcggtggcggccaccccgaaggctccggccgacgagccgctggagcccaccctggaggagcctccgaagcgcggcgagaaggtggtcaagctgcgtccggagcagaccgacgagggctacaagagcgtctactccgagctgacccgcccgaccgcggcctcccggctgcggacgggcatccgcggcgccggcgagctgatgatcactttcggtctgatcgtgctgctgttcgccggctacgaggtgttcggcaactcggccgcggtgcaggacgagcaggatcatctcgcgcaggagctggaccagtcgtggaacgacccgaccgtctcgccgagcaatgcggtgaagggcccggccgctcccggtgacaacctggtcggccgtctctacatcccgaagctcgacaaggagtgggtggtcgtcaacggggtccgggcgcaggacatcaagtacgccccgggtcactacccggagaccgcgctgcccggccaggtcggcaacttctcggtggccggccaccggatcaagaagatcttctggcggatcgacgagttgcagcccggcgacgtgatcggcgtcgagacccgcgactcctggtacgtctaccaggtgtacggccagcaggtcgtgaagccgaaccaggtcgaggtggtcgacccggtgccgaacgagcccggtgtcgccccgacgaagcggctgctcacgctgaccacgtgcaacccgaagttcaacaactaccagcggctgatcgtgcacgccgagctggtcaagtcggtgccgcgggaccagaccaagccggacgccggcatgccggccgagatgaagacgaaggcctgacggatgtacgcctggatctggcgcaagctcccgggacagctgtggagcaagctggccatgtcggtcgtgctgctcggcacggtcggctggctgctctggaatgtgatcttcccgaaagccgtgccgctgttgcccttcgacgacgtgcaggtcggcgacacctcgcagatcgacccgaactcggtcacccccgaccaggtgccgggcccgtcggccgacccggacgcgtccgcccccgacgtgatcccgtacagcacgtcctccaaccaccccgaccccggaggcctcgccggtgactgacgtccgcattctggtgatcgacaactacgactcgttcgtcttcaacctggtgcagtatctgggccagctcggcgccgagtgcgaggtgcgccgcaacgacgagatcaccgtcgaggatgcggggcggctcggcgcggccggcatcctgctgtcgccgggcccgggtgagccgacccgcgccgggatcatgctggacgtgatccggtcgtacgccggaaagatcccgctcttcggggtctgcctgggtcatcaggcgatcggggcggcgttcggcgcgaccgtgacccgcgcgccggagctgctgcacggcaagacgtcgctggtgcaccaccgcggtgtgggtgtgctggccgggctgcccgacccgttcaccgcgacccggtaccactcgctggccgtgctgccggagacgttgccggacgagatcgaggtgaccgggcgcaccgattcgggtgtggtgatggcgatgcggcaccgcacgctgccgatcgagggcgtgcagttccatccggagtcggtgctcaccgagggcggccacaccatgctggcgaactggctggccgcctgcggtctgccggaggcgctggagcgggccccggaactggccgccgaggtggagacgcggcggcggtcggcgttcgccaccgcctgatcattcaacgacagaaggagccggcatccgccggctccttctgtctgtctgacctactcgttggtcccgatgccgccaccggtgccggaggtgtccgtcgggtcgggtgacgggtctccgctcggcggggtgtcggtgctgacgacggtgatcgagatgggatcgcccgccttcgccttgctcttcggcttccggctctggctgatcaccttgcccgggtcaccgccggtgttcacggtttccacggtgacgttcaggccggcgttctgcagcagcgccatggccgcgtcctggctgcggccgaccacgtccggcaccaggatgagctcgttgttcgagatgctcacgacgatctcggtgcccggcgggaccgaatcaccctgctggtcgacgttgacgacctgatccttcggcgaggtgctgtcgacgggcttgaacttcggcaccaggccgacgttccgcagggcctgctcggccgaggacttggtgccgccgaccagaccggtcggcacctgcaccgacttcggcgggttgcagatggtgtaggtgacctgggtggtgaccggcaccgtgttccccttgggcggggtctggtcgctcacctcgcccttgcagtccttgtcctctttcggatcaccggcggtgacgttggtgaacccgagctggctcagtttctgctgggcctggcccgccgtcagccccttgaggtcgggcacctgcgcctgcgcggccggtttctgatcgccgcccttgtcggtcttgttcagcgccagcgcgacgccgagcacgatcaccacgagcacgcccaggccggccagcgcggcccacacccaggactgcctgttgtcggccggacggccgccggccaccgcggccggcatcggccgctgcatggtggtggcggcctgcggctgccactggcggggaccgttgttcagggcgaccgtctcggcctggttcatcaccggggtggccatgaccgggcggccggagaccgcgcgcagcgcgtcggcgcgcatctcctgggcgctctggtaccggttcagcgggtttttcgccagggctttcagcacgatcgcgtcgacgtccggcgggatgtcgcggctgatcgagctgggtgcccgcgggtcctcacggacgtgctggtaggccacgctgaccgggctgtcgccgacgaacggcgggtgcccgacgaggagctcgaacaggacgcagccggccgcgtacacatcggagcgggcatcgaccgcctcgccgcgggcctgctcgggcgacaggtactgggccgtgccgatcaccgcgctggtctgggtcatcgtggtggcgccgctggccagggcccgggcgatgccgaagtccatgaccttgacctggccgttctgcgtgatcatcacgttgcccggcttgatgtcccggtggatgatgccgtgccggtggctgaactccagggcggcgcagatgtcggcgatgatttccagcgcccggcgcggctgcagccgctgctcctgggcgaggacctctttcagagtgcgtccgttgacgaactccatgacgatgaacggaagcttctcaccggtggcggaaatctcctcgccggtgtcgtagacggccacgatggccgggtgattcagggccgcggaattctgcgcctcgcgccggaaccgctcctggaaagtggcgtcccgggccaggtcggtgcgcaacatcttgatcgcaacgtcccggccgaggcggaggtcgcgtccccggtgcacctccgccatgccgccatagccgagcagctcgccgacctgatacctgccaccgagcagtcgggcctgcgccgtcatagcgtctgtcgtccttcgttcggtcggatcaggccgagctgggggccggccttcattagacggtacgacgccgttgacacccggtcgtcggccacgcccatgcggaggatagccgccgagctgctgcgatcacccagcgcgttttcggcggcggctgcgctgatgccatgtcgatacaggaacgagatgaccccggcacacagcaggacgagaagcgccaggacgacggcgagcacgatcagcacctgacggccgaaggcgccctcgggcttggtcatccgcatcggctgctgcgggtagttgctgaccggcggaccggacggcggacggtagtgcggcggcatcggcgtcggtaccggcggcgcggactgtaccgggggcacggacggcaccggcggcaccgactggaccggcggcaccgaggacggcaccgatgcggcgccccgggcacccgagatgggccgcggcaccgaggcccgggcctgcggcgccggaccggacgaggtggcccgcaccggctggtggtggttcatcggcggctgcacggtggtggtcagggaggcggcggcctgccgggcgaccgcggccatcgccgcggcgctgggccagcgggcggccgggtccttggagagcgcccgctccacgatggcgcggaccgccggcgggatgtcgccgggcagcgggcgcggcgtctcccggacatgcttcatcgcgatctcgatcggggtggcgccgtcgaacgggcggtgcccggacaggcactggtaggcgaccacaccgagggcatacacatcggaggccggggtggccacgtcgccggcagcctgctccggcgagatgtacgacgccgtgccgagcaccgcgccggccaccgtgagctgcccgaccagggcggaccgggcgatcccgaagtcggtcaggaccagcgtgccgttcggccggaccagcaggttgccgggcttcacgtcgcggtgcacgatgccgttcgcatgcgcggcctgcagtgcgtcggcagcctgcgcgaccagggccatggtccgggccggggtgagccggccgacccggctcaacgtgcgcgacagcgcgtcaccctcgacgtactccatcaccaggaacgcgagttgctgatcgctgccgtagtcgtagacgtcgaccacaccggggtggttgatcgtcgccatggtgcgcgcctcgccgcggaaccgctcggcgaagccgggctcgtcgagcagcgcgggcagcaagatcttgacggcgaccgtccggcccagcacgtcgtccgtgccgcgccacacgtcacccataccgccgccggcgatccgctcctccaagcggtagcgcccaccgagcgtgacccccgggcggatcatgtcagttccctcccccgccggccgcggccttcatgatcaggcctgcgatccgggcagcttcggcgctggcgtgaccgccggagacgttctccagcatgacgcagacggcggacaccgcctcgcccttgtcgttgaacgcgaagccgatgaaccagccgtgcgggttggcgccctccgcgttctgcgcggtgccggtcttgccgccgacggtgaaaccgtcgatcttcgccttcttgccggtgccgttctcgacgacactgaccatcatttccttgagcttcgaggcgacctcgccgtcgatcgggttgctgcgcttcttcggggagaccgtgtagatcgtccgccggtcctggctgaccagcttctgcaccaggtacggccgcatctgctcgccgccgttggccaccgtggcggcgatcagcgcaccctgtagcggcgtcatccgcacgtcgcgctgcccgatcgaggactgggccagcgcacccttgtcggtggtgccgtccgggttcgcgatcgcgccggtgtggctcgccgccaccggcaggccgtcgccgctctccaggtcaccgaccttgagcgactcgtcctcgaaaccgaacgccttcgcctcggccttgaccttgtccgcgccgagcttcacgccgagcttggcgtacccggtgttgcagctctcggtcagcgcctccttgagcgagatcgagctgccggggcagacctcgtcctcggcgttgcggatcaccgcaccgctctcctcgtacacgctgccggccgggatctggctgtcgacgtcgtacccgttctgcagggccgccgccgagacgatcaccttgaacgtggagccgggcggcagggtctgcgacagcgcccggttcagcatcggctgatccttggtcgcgttcagctccttgtacgccttggccgccgcgttcttgtcgtgcgtggccagcaggttcgggtcgtagctgggcatcgagacgagcgcctggatcgcgccggtgcgcgggtcgatggccaccgccgcgccccgcttggcgccgcgctggttctcggtcatctgcttccaggcgacctcttgggccttggtcttcagcgacagcaacacgttgccgccgccggtctcctcaccggtgaacatgtcgctgagccggtcggcgaagagcttgtcgctctccccggagaggaagtcgttctcgctctcctcgatcccggtggcgcccaggttgaccggcttgtagccgaggaccggcgcgtagatctccttcttcggatagacgcgcaggtacttcagggtgtcgtcggtcgccttgttctcggcgagcggggtgccgtcggcctcgatgccgccgcgggggcgctcatattcggccacggtgacccgcgggttgcgggcggccgtgcggtagtcgtcggccttgtaggcctgcacccagttcaggttcgcgaaaatcagtccgaacagcacgaggacgaccacgccggcacggcggaggggggcgttcacggcttgatcacctccgtcatggcgccgtgcagttgggtgggggccttcttcggtccggtggggcggtcctgtccgccgccggcggccgggccgcgggccgcgttcgagatccgcaacagcatcgccaccagcagccagttcgccatcagcgaggagccaccggcggacaggaacggggtggtctgaccggtcagcgggatcagcccggtgataccgccgaggatcacgaagatctgcaggccgagcgtaaaggccaggccgccggcgaccagcttgccgaacgagtcgcgcacggtcagcgcggcgcgcagcccccgctcgacgatcagcaggtatgccaccagcagggcggagaggccgaacaggccgatctcctcacccaggccggcgaagatgaagtcggtgcggacctcggggatgaagcccggtgagccgccgcccggcccggagccgaacagcccgccggtgcccagcccgagcaggccctggacgagctggtaactgccgcccacccgctcgtagttggcggtcgcgaacgggtccagccagacctgggcacggtcgtagaagttggcgaacggaccgccgatcgcggcgcccagcaggtaggccacgtagacgccaccgaagaacagcagcaggccgatgatcaaccagctggaccgctcggtggcgacgtacagggtgaccacgaacaggccgaagtacatcagggcggtgcccaggtccttctcgaagacgaggaccaggaggctgagcagccacacggtgagcaccgggcccaggtcccggccgcgcgggaagtccaggccgaggaagcggtggctggccagcgagagcacctcacgcttgcggaccaggtagtacgcgaagaaggagaccagcgccagcttggcgaactcaccgggctggatcgagaacgcgccgaacttgatccacagcttggcgccgttcacctcggagaggctgccgggcagcacggccgggatcatcaccagcacgatgccggccaggcccagcgtgtacgcgtaccgggagaccaccttgtggtcacgcaccaccagcagcagcaccgcggccaggatcagcgacgccaatgtccaggccagctggcgtccgccggtgccggcgaacacccccgggatcgggtccttgttggcgatcgcccgggccaggtcgagacggcgcaggaacgccaccccgatcccgttgatcagcgcgaccgccgggatcagcaccgggtcggcgtacggcgcgacgaaccgcaccaccacgtgcagccccaggaacagcaggctcagcagggccggcggcacccagaacgtaccgctgagcttgtcgaactggttcgcctcgacggtggccgcgaacgtcgcgaccagcagcatggcgaaggccagcaggcccagctcggcgttacggcgggtcttcaatcccgggatacgcgacagctcacccgtggacgagggcgaaggagccggtacggcgggcgcggtcaagaaaatccccagacgttgtaggccgtgctcagtcggcggtccggcagccggtcgtgtcgaccggcgcggtggacgcgctctcggacggttgaacgctcggcgcgatcgccggagcggacgacgccgtggtcgcggccgggcgcaccgcgccggaagcggacggcttcgcccccgccggcttcgtcacggccggcttggcgccggccggggtggaggcggccggggttgcggtggccaccgagcagaccggcttcaggttcggattggacggctcgtcgctggtcagctcggtcagcatgctccgcgcgtcgaccttgctgccggcgtggatgccctgcttgacccgatcctgggcgaccgtggtcagctcgtccaggcggaccgtgctggcctcgctcaccgtcgacaggtcgagcccggcgatctgcccggggacgccgcggaagatggcgagttggccgtcgtcggtcgcgccgacgtaatactgatcctgggtgtaccgccagccggcccagaggccgccgcccagcaccgcgagcaccagcaggaccagcaggccggtccgcaccgggtgaccggcgggctcggcgtcgcggtcgaaggcgtccggctccggctgggccgggcgcggcggtgcctgcttgagcgcggccgcccgggacgccggggtggagctgtcggccaccgtcgtgttgccccggtcgagggaggccgcaccaccgacgatcggcgcctgctcgacgatgtccgcgtcggtcgcgtcggcgatcaccacggagatgttgtccggcccgccgccgcgcagcgcgagctgcacgagccgctcgacgcaggccttcgggtcggcgatctcccgcatcgtctggccgatcgtctcggcgctgaccacgccggacaggccgtcgctgcagatcaggtagcggtcgcccttgagcacctggcgcacggagtactcggggtcgatgtcccggccgtccagcgcccgggtgagcagcgaccgctgcggatggctgctcgcctcctccgggctgacccggccctcgtcgaccagcatctggacgtacgtgtcgtccttggtgatctgcgcgaactcgcccttgcggagcaggtaggcgcgggagtcaccgatgtgcaccatgccgaacttgctgccggtgaagagcaccgcggtcagcgtggtgcccatcccctccatctgcgggttggcgtcgacggtgtcccgcagctgctgattcgccgtcccgacggcgtgccgcagggcgtcgaccagcgcgtccccggggacgtcgtcgtcgagcggcgccatcgcggcgatgacgatgttggaggcgacgtcaccggcggccatgccgcccatgccgtccgcgacagcaagcagccgcggcccggcgtagacggagtcctggttcaggtctcggatcagaccgcggtcgctctgagcggcatagcgcagggtcagggtcatggccgtaactcaagagaagtgcgtccgatccggatcggaacgccgagggggacgggggtgggtccggagaccttaccgcgatcgaggtaggtgccgttggtcgagccgaggtcctcgacgaaccactgcccgtcccgcggcaccagccgggcgtgccgggccgacgcgaagtcgtcggtgatgaccagggtggaatcctcggcacgaccgatcgtgatcggcgcctcgccgagcgtgatccgggtgccggccagctgaccggcggtcaccaccagctgccgagccgccttaccgcgcttcaccttcgccggccgaccggggagcaccacgccacccaccccccgggggctggcgacgatgctcttcgaccgggcgcccgcgaagagatcccgccggatcaccccgaccaccgtgaacacgaagatccacagcaggatcaggaagccgaaccgggcgacggtgaggacgaattcgggcaaggccgctagccgtccactcggaaggtcagcgtggtggtgccgagctggatcatgtcgcccgggttcagcgccacggcggagacccgctgcccgttcaccatcgtgccgttggtcgagccgaggtcggtcagcaccacctggttgccgtcgtagtccagccgcgcgtggcggcgcgagataccgacatccggcaggcgcaggttcgcctggtcgccgcgaccgatcacggtcgagcccatctgcagcgggtaggtccggccgtcaccggagaccaggccgacgctgcgcgggccgccgtgagcaccaccgccgtgcggcgggtaaccgccaccgtgctgctggtcgtacggcgagtactgcggaccggcgtcgtaggccggctgctgcaccggggcgacctcgccaccggtgtagacctccgcggtcacccggaacatcccggtgtccaggccgtcgccacgctcgatctcgacgatcacgtcgccgtagaccgtccaggcctgctcgccgatgaactcggcctgcgactgggccagctcctgcgccagggcggccgcgtacggcgccaggcgactgtggtcgtacggcgaaaggtcgatcacgtagcggttgggcaccagggtgcggccaccggcgaggatcgctttgtgcgcctcggcctcccgctgcatggcattcaggatctccacagggtgcacgacacccttgaacaccttggcgaaggccccctcgaccaggccttccaatcgcttctcaaagcgctgcagcacgctcaccggctcctcctcgggttccgaggacatgatggtatccggccgccgcttgcgcatcctcagcccaagagcagccggcacttctgaccctcgtatgacgcccctcgacgccgtgctagtgtttcctccgtcgcggggcgatatcaacttcaactgggttgttactgtcctcgacaactactcgcgacagcgtagtctgttgcaggtagtaacccgaaacaggccctcgggggccggtttcacgggtcggcgaggtcggttataggatctcgacgaccaagtcacatggggatgtggcggaatggcagacgcgcacggttcaggtccgtgtgtccgaaaggacgtgggggttcaactccccccatccccacgagtgcgaatgggcgaccctggtccgcgaaagcggcaccgcggtcgccctcgtcatttctgccctccgatccggtcggggcggaagtgcggcatgtcactctccgttcgtggtcggcacgggcccgcccttcgggcttcgccacgtccgggagacctcgggcctgggtacggtgtggtgctcccgtggctctcaccttcccgatcgggtgaagcgatatgctcgcgcgcctgtccgaattccaagtccgttcgaccgttggggtgtgacgtggtcgctgtgcctgctggggtcaaccaggggaagcgcaacgtgctcggagtgctcgtggatgccaccgactacgcgtcggcgaccgagcggatcatctcggcggcgcgggagggccggccgtacgcggtgaccgcgctggccgtgcacggcgtgatgaccggggtgcaggatccggcccacgaggcgcggctcaactcgttcgatctggtgaccccggacgggcagccggtgcgctgggcgctgaacctgctgcacggcgccgggctgaccgaccgggtgtacgggcccaccctgaccctgcgggtggtcgagcaggccgcggccgagggcctgccgatctatctgtacggctccacccagccgaccctggaccgtctggtgccggcgctgctggagatgttcccggcgctgaagatcgccggggtggaggcgtccaagttccggggtgcccagcccggtgaagaggtggagatcgccgagcggatcaaggcgtccggcgcccggatcgtgctggtcggcctcggctgcccgcggcaggaggtgttcacctacgcgatgcggccgctgctggacatgccgctgctggccgtcggcgccgccttcgactaccacgccggcctgctgaagaacccgcccgcgtggatgcagaagtacgcgctggagtggctgtggcgcctcggcctggagccgaagcggctgtggaagcggtatgtgctgctgaacccggcctacctgagccggctggccgcgcagaagaccggcgtgtggaaggccatcccggcccagccgaccggtgagcaggtccacggcttcgccgtctgaccccggtccgggctgtttctgatcatccgtgccgccgggtgcggatgatctctttttgcgctgggcaccccttcacccactcgagaaccggcgccggagtcatctcggtaacgattctgattctcagcgtgaccgcccccgggcggcgtttcccctgccggtcctgatcggacggaaacccctacgggtggcggctgggggctttcccggttccctcacgggcgccgcgggtgaacgctgtcgatgtgaacaccgctgtggacgtgactctgatcggggccctcgccgccgtctggctgaccgccggactgctcgccgacggcctcgcggcggccagcaccgcgcattcgatgcgccgccgggccgggttgctgaccgtcctggccggtgcgggggcggcgttgttcgtcgcggtgccggtggccaccgccctgctgccgggcgcctcgtcggcgcccgtcgcggccctgctcccggccgtgccggccgtggtcgtgctgaccgccggtctccgcaaactgagctgggtgcgccggggcgcgggcgccttcgccaccgccccgcaggcctagctagctagcgtcgccctgccgctggccgccggcctgctcaccccgtcggccgacgaggtcccggccaccaccgggatcccgggcgtcgccggcctggccatcacggtcgtcgccgtgctggtcaccgtcatcggcatccgggccgcgatccggcacagccgcctggccccgctggtcctggctcccttggaccgcgtccgccagcgcgcccgagccaccacccactgaccactggacggcgagggccggccgtgacgagcacggccggccctcgccgtcggtgcatcctggcggtcaccacccgatcgagccgcggcactgcggcgggcgcggcgcaagcgtggatgccgggtttcggtgaccacccacgggcaatgaagggtcgcgatgatcgttcgggacgcgccagcggcctgatcatcgggacccggccccggcggaagcggcgattggttatcagcgcggacgcacgacatcaagatcttgaagttgaccttgagattggtctcacgaacgtccgggctccggctccgtcagtgggcctgtttcttggcctcctggacgtagagcagttccaggatggagcgcgcggcctcgaaccaacggtccagccagtcggacggcggcagcgtgccgcgtgccgggagttccagcagcaggccgcggagcagcgggtggtcggccatcgacgtgttcgtgccgtcgctccagctggccgagaagaccggctcggtcaggccgtgcaggtccagcgagggcagtttggccgcgcggtccagggcgctcgccggctccaggctgcgtgaatcgatgctgcgggagtggccgggtgaccgggtcggcagacctgagctgccgcgggacaggagttccccgtcgccgaggtcggcgtgcagggcttcgcggcggccctgccggtaggcgctcacgcctccgctgaaacggtcctgcgccgtcgacgaaccgttgctgaggttctccgaaccaatcgtcatctgtctgccttgcctcgttgaaatccggcctcagcgcggtccggtccgcgcttggaacattcaacgaggcgcgccgcgctcagcgacgccacaattcgggcaaatacccccggccagcccgttggtgcaggtcagcgggctggccgaaagcggactcagagatcgaattcgccgtctttggcgccgtgcacgaacgcgtcccactcggccgacgtgaagatcaacgccggaccggactggttcttggagtcgcgcaccgcgatggcgccgtcgacgaaggccacctcgacacagttgtcgctgtctgcaccgcttcgggtgctcttgaaccactccgcccggctcaggtcgacccggagtcctttgacctcaagttccacgatggctcctcaagtccaggggtgtgccggtcgcgattaccgtcagcgaccgtcctgaatcctgtaacgaccgtgggtacggacggacgcggcttctccgttcggggtaatcccatcggacagcatggatcctgcctgctcaggcgagtttagacagtgattgtcagcgtttcaggttttatgtccgaaatgttctaagcattgtggatcatgtgcggaaatcccggcacattaggctcaccagcggaagtctcgtgatcacttagcgatgtgccatgatcactcaggatcacggaagaggtacgtgcaacttgcatcgacgacacccttggtgcaatctttccgtatggcttgcatcacttaacgttcttgagggatgcctcagcgttcttgagggatgtggccaaagtctgaccaaacacaccaaagcgacgtccgatacggggtgccgagccaccgggagtccctcgtggactccctcccgatacctgggtggcgggatcggcgatggtgacgttccgcaactccttcgatggttggcattgtcgaagggttgcaaaggtgcatgagccgggcagactggtgcatctgtgtcacaggtccatccacctagggccggtccggccctaaccatccggcaacgagtctcagggcaggagatgacgtgctacttcctcggtccggtgatgtcatccacgtgacgaaagcggcgagcgtccaattcgcaacaccgatgctcttccgggtcatccgggtacacgactggccgacgtacgagggttgggtctggctcgacggctacgagctcaactcggccggcgacgccgtggaacgccgctcaatctttgtgcaggtcaacgggttacgcccggtcggcaaggcgcccgacccgcgcgcccgcaacggccgtcagccggccacgcgcccgagcgtggcacccgtccggccggcgcgggctccccgctgaggggctagccgccgttcggcgtcgtcggggccgggccacccgttcgcccggccgcgacgacgagggtgatcgccgtgtccggcgggaccacccggccctccggcgggtcactgtcgatcaccgtgcccggctccgcgtcgctgggccggccgatcacccggtaccccaggccgctgcgctgcagagcgatcttcgcgtcggccagcggcatcccgcgcagagccggcaccgccacctcggtggtggccggctcggtggtcaccaccgtcgtctcgaccggcgtcggcgggacggagaccgcggtcgtcgtgggcgccgtcgtcggggtggccgacgtggccggcacggtggtcaccgcagccggcgccacagtcgtcgtcggagccggtttccgggcgtgcagcgcgatcacgtagatgccgtaccccagcagcgcaagcaggagcagaccgacggtgccgaccacgatcggcatccaccagtggccggccggctcgccctcgacctcctcgtcgacctcatagcggtccgaattctgatcgaaagcggacgggcgcacctctgcgcgaccggtccacagatcgtcctgcggcgcgggatcccagtccggctggcgctcgtccatcaccgttccctccgctgcgtacacccgatctcatcgcagcgtcaacgtatcgaatctcggggtaacccggggggatgctctgaccagcaagggtatttcgcggacatcggtggaggccagtacagtgcgcggcatggccgacaagggctggacagcacaggccgccgcggcggccggaatagccgccggcgcgggcgccgcgcaactgggtctcggctacgggctcggcgtgatcgagtggccggccaccgcgaccgcgaccgacagcacctggctcaacagcctgggctgggccacctggatcaccgcgagcgccaccgtgctgggcgcggtgatcgccgggcggctgcgcgccgaccgggccggacgctggcgcaccctgtggcggatcgcgctggccgcggccgccgcactgggcgccctggtctcggtggccctggtcgcgctgcccgcccgctccgcggcgcagaccccgctgttcacccattcgccgcaactggtggcggtcagctactccctgatcgggctcctcgccggagtgatcgtggcgttctgggcggtctcctcggcgccggtcgcggccaacttggtcggcaccgcggcgtggctctgggcgctggccatcgccggggtcaccgccgagctcagtaccaaccggaacctggagacgtacctgacgagctggcagttcgccgaggatcagacgccggtgcggtacggcgggatctactggccgagtgccctgctcaccctggccgcggcgttcgccatcgggctggtcgcggcctggccggcggcccgccgcgggcggctggggctgggcacggcgacctccggggcggtcgggccgctgctggtcgcggtcgccttcctggcgctggcgccgctgctgacccaggccgcggggccgttgcagtccgcctatctgatggcgccgtacgcggttctcgccgggctcgccgggtccgccctgaccgtgtcgctggggcggagccggggccgggcggcggcgagtgggccgctgaccgagccgacgggtgggcccgcggcggccgccctgcccgccgcgccgtccgcacccgcgtcgtccgcgtcgtccgcgacctcggcggtttccgctgcaccgtctgagccttccgccacccgatccgcatcttccgccacccggtccgcgtcctccgctacgcggtccgtagctcccgctgcgccgtctgtggcgtctgcgccgtccatcgcgccgtccgccgcgccttcggtgccggaaagcgcgccgcggggacgctggtcgcccttcggcaggaagcgcccggccgaagagccggccgcgccggccacccaaaagcccgccgaaaagcccacggcccagcccgccgaaaaacccgcaccgaagtctgcggccaaaccgaccggaaagactgcccctaaaccggtcgaacccctcaccgcgggcctcgccgatccggagctggccgccgccgcccgctcgagcaaggccaccaagcgcacccccacccgcaaggagccccgctccacgatcaccccgcccccggccaacccgccgatcgcgcggatcaacccggacagctgagggcgccacccggactttgccggatgacgccctcgcctgtggacggtgcgacggtcaggcctgcagcactgcctcgccctcaatctcgatcttgacgttcttgctgaccatgaagccgccactctcgagggcgacgttccagttcagcccccagtcgtcgcggtcgatctcggtggtcgcgctgaacccgaagacgtgctgcccgtacgggctggtggtggcgccctcgaactcgacgaccagctcgaccggcttggtcacgcccttgatggtgagctcgccgtcgaggacgaactcggtgccggcgtgcgacttgatgccggtgctccggaactccatggtcgggtacttctcggcctcgaagaagtcgccggtgcgcaggtggttgtcccggtcgacctggccggtctggacgctggcggtgttgatggtcgcggtgaccgaggagtccagcgggttctccccgaccacgatggtggcgctggcctcgctgaactggccgcgcaccttgctgaccatgaggtgcttcacgacgaagccgacccgcttgtgcgccgcgtccagctcataggtgccggccgcggggaactgcagaccctcgaactcgcgcgtgctgacggtcatgactggtccttcttccacaagtccgagctgatgcttgtctgacggagcaactatatgcttggcaatattccctctgtcaagtgcctgttatcgtggaaggcgtgaacaccgatctggacgacccccgtctcaccgcggtcggcctgctggccgaggcgtacacgggtctgatgaaccgcctcgccgcacagttcgaggagcaccgcctctccaccgtcgagttcgaggtgctgatgcgcctcgcccgatcgcccggcaaccgcctgcggatgaccgacctcgccggccagaccactctctccaccagcggcgtcacccgcgtcgtcgaccggatggaacgcgacggcctggtccgccgcgaggcctgtcccagcgaccggcgcagctcctacgcggtgatcaccgacgccggtcaggagcgcctggcccaggtccttcccggacatctggaactggtccagcggtggtatgtcgggcttctcccgcccgagcatttcaccggactgctcgactcgctacgcacgatccgcgacgcggtcaacccgagcgcgacagcggggagtgcggaagcggtcacgcaggcctgaccagaccggcagaaccaccggcagaacgggcgaatccgctcggttgcccgcatcgcccggctactgttggccgcgcccagggggatgcggcgcgatcgaggcgacgtacggggcttacgggggagttctcgttctcgccgcgtgcgggtgcggcgtagcggcgatcggcgcggcgtggggggcacgctcatgcaccgatcgcgcacgccgcacccggggcttcctcgcccgtcatgccagattccgcagatccaccgactacggcatgtccgcctcggcggccggccgtccggccggcgctccggcatgccggaatcggtcatccgccagctcaccctcgacagcggcccgcgcgagggcgtaatcccggaccgcggacggcagccggaagcgcacccccggatcgccgctcacgttgagcaatcccagcgccaccaggcgatccagcagatgcacgacctccccgcccgggttgtccgatgtggtcagcagcgcctcggccgactcgcgtgaccaccgctggcgaaatgtcgccagcaaccgcaatgcccgttgctccgccggcgccagcagccgatacgtctcccccaccaccaccggcaacgcgatcaccccgggctcggcggaggccgggtgggtgaccggagcctcggcatagctcgccaggatctccgggacggtcagcacccggccgcgcgccgcggccagctcgatcgccagcggcaccccgcccagccgccggaccagtgccaccagcggcacgagctcgtccggtgccaggtggctgcgccgcacccggcccagccgttccaggaagaggccgattgccgggtacgtcatcagctcgccgaccgtgccggtcaccgacccacccggtggcatggcgagcggcagcaccgtccgtacccgttcaccgtcgagtccggccgccgcccgcccggtggccaggaaacgtagctgcggcacctccgccagcagttcggccagcacctcggcggccacgctgggcgcccggtcgagcgcgtcgacgaacagcagcaccggggccccgccgggctccgccacccgggccgctcccggcccggcgagttcctccggccggctcaccccgaagccggcgagcagtccgccggtcagctcggcggcggtgaccccgtcggccaccgcgaccccggccaccccgcccgggtaggccccggccagccgccgggcgaccaccgcggccaggctcgtcttgcccaccccggcggcccccaccagggtcactccgcgcggcccggccgggtcggcgaggctcgcggtcagctcggcgatgtcggtgtcccggccgatcaggtcgtcggtcggcgcggagcgcaggaacggggtgccggccggccggctccgcgccgcggccaggaaaccgtcgtggtcggcgccggccaggcccagggcgcgggccagcaggtcggcggtggtccgctgcggccgggcggcccggccacgttcgaggtcacggaccgtacgcacgccgatggcggcgcggaccgccaactcctcctgagtcaggccggcacgccgccgaagttcgcgcagcagggcaccgaagccctgatcggacgccatgctgcgaaactaggcaccgcgatcgatcaacgcgaacccgaaaggccggtttgtcggtaagctgactctcggtaatggaccctagagtccgagcccgcgggcgatcagcatgcgctgcacctccgaggtgccctcgccgatctccaggatcttggcatcccggtagaagcggccgaccgccgactcgttcatgaagccgtacccgccgtgcacctgggtggcgtaccggctgttctccatggccgcgttgctggcgttcagtttggcgatcgccgcgtaccgcttgaagtcctcgccggccagcatccgggcggccgcgtcgtagtagccgaggcgggccaggtgggcgcgcagctccatgtccgcgatcaggaactgcacagcctggttgtcgccgatcggacggccgaaggcgacccgctgcttggcgtaggccaccgactcgtcgacacagccctgggccaggccgacggagagcgcggcgatcgcgatccggccctcgtcgaggatccgcaggaactgggcgaagccccggccccgctgaccgagcaggttctccgcgggcacccgcacgtcgtcgaaggacagctcgtgggtgtccgacgcgcaccagccgaccttcgagtactgcggggcgacggtgaagccgggggtgccggacgggacgatgatggtggacagctcacggctgccgtccgggttcgtcccggtcgccgccatgaccgtgaccaggctggtgatgtcggtcccggagttggtgatgaaggccttggtcccgttgatcacccactcgccggtcgactcgtcgaggaccgcgcgggtggtggtcccggccgcgtccgagcccgagccgggctcggtgagcccgaaaccggccagtgcctcgccactggtgagggcgggcagccagcgctccttctgggccggcgtgccgtaccggaagatcggcatcgcgcccagcgagacggccgcctccagggtgaccgccaccgagctgtcgacccgggcgatctcctccagcgcgatgcagagcgcgaagtagtcgccgcccatcccgccgacctcttccgggaacggcaggccgaacaggcccatcttccccatctgacggatcacgtcgtacgggaacgtcttgtgctcgtagtgctcggcgatgaccggcgccacctgctcacgggcgaactgccggacgctgccacgcaaatcctcgagctcgtcaccgagccggaaatccaccatttcgctgcttcgcttccttagacggtcgctgctctagacaggggtgacgccatggcggcggcgggagaacgtgcggtccttgccacgggccgccgagaaccgccggatcagctcggcccgcaggtcgccgggttccaccacggcgtccaccacgagctcgctggccaggcgcatgatgtcgatgtcgcgctcgtactcggcgcgacgctcggcgacgaaggcggcccgctcgtccgggtcctcgatcgccgcgatcttgttggcgtagaccgcgttcaccgcggcctcggcgcccatcaccgcgatcttggcggtgggcagcgcgatggtggcgtccggctcgaaaccggggccggccatcgcgtacagcccggcgccgtaggccttgcgcaccaccacgcagatcttcggcacggtggcctcggagatcgcggtgatcatcttggcgccgtgccggatgatgccctgtttctccacggccgagccgaccatgaagccgggcacgtcggcgaggaacagcagcgggatgttgaaggcgtcgcagagctgcacgaaccggctcgccttgtcggccgagtcgacgaagagcacaccgcccttgaacatcgagttgttgcccaggacgccgatcacctcgccgtcgagccgggcgaagccgaccgtcagctcgcgggcccacagcgcctggatctcgaagaacgagccgtcgtcgaccagacccttgacgtaccgccgcatgtcgaacgcctgccgctcgctggccgggaccagcgcgccgagatccgccccggacgaatccgtcgcggacgccgaaggcggacgctgggtccagttctgcggcacataggacagatagccgcgcacgacgtcgagcgcgtcctgctcggtcttgcagaggaagtggccgacaccggactcggcgcagtgcacccgggcgccgcccatcgcctcgagcgtcgtcttctcaccggtgaccatctcgaccatgcggtcggagcccagatacatgctggcgttgccctcgaccatggcgacgacgtcgcagaaggccggaatgtacgccccgccggcggccgaggggccgaacagcgcgcagatctgcgggatcgagccggacgccttgacctgggtatggaagatcttgccggcaccgcgccgaccggggaagaggtcgacctggtcggtgatccgggcgccggccgagtcgaccaggtagatcatcgggacgccgagctggtaggcccgctcgatgacgcggacgatcttctccaccgtgcgggcgccccaggagccggccttgaccgtggagtcgttggccatcacgcacacgtcgcggccgtcgatccgggcggctccggtgatcacaccatcggcgggcagtccctcggccagactgttggcatagagcccgtcctcgacgaaggaaccctcgtcgaccaggagcgcgacccgctcgcggacgaacagcttgcccttgcccgcgttggcggcgtggtagcgctcggcgccgccggccagcacacgcttgcgaacctgcgcgagcgcgtcgccgtccatgcgttccccctcgttcaagtttccttaacgttcgttagacttaacgaccgttaggttagctcaaacgaagatcgccggcaacgccgaacgggagccctcgcggaaagcgaggactcccgtcgtgctgccggcacggtggagacgcgaccggcgcgcggtggacgcccgggacggcgcccggccgcgtcagcgcaggctgtcgagcaggtccagaccacccaggctgccggtcaggccgctgaccgaggtgctctcgatgttgttgcggccaccggtggagtcgccgtacttgtccgggctgacgtcgccgtagcccttgtcacccttggcgttgccgttgttgtcgtccttgacgtcgccgtagccggtgtcggccttgtggcccttgtgaccgtgacccttgtggccgcccttgtcgcccttgacgtcaccgctgttgtcgtcgttgctgtacccgttgtcgtcgttgaccgcgggagcctcgccgccaccgttgtagccctggtcgccgcggacgtcaccggtgttgtcgtcgccgcagccgcagttgccctggccctggtcaccctggacggcgccgtggtggccgtgccggtggcccttgacccagaccgggccgctgtcgccgatccggttcacgcagaacgcctgcgagttcgcggtgcccagcagcgagccgagcgagttgccgcaggcgttgatcggcgcgacgaccggcgcggcgaactggctgccgttcaggaagccgatgttgccgaagctggactggcggatgccgttgtcccagccgccgacccggttcccgccgccccagttgtcggcgccggcaccgccgccccagttgtgggcgccggcaccgccgccccagttgttggcgccggcaccgccctgacggacgctgcgcccggtcggcccaccgatgaagttggcgcaggtggcctgggccgaggagaccccgaacaggctgtccgcgttgccgcactggttgatcgggatggtgatcggcacggcgatctgggtgccgttcaggaagccgacgttgccacccgactgctgcgcgatgccgtcgttccagccaccgccggcgacgtgcgcaccctcggtgacgtggttgaccccgctaccgcgcgccgaggagaccccgaacaggctgtccgcgttgccgttctggttgatcggcacggtcaccggcacggcgatctgggtgccgttcaggaagccgacgttaccgcccgactgctgcgcgatgccgctgccaccgcgacgggcccgggagccctcggcgatgtggttgacgccgccaccgttggccgacgagatcccgcccagcgcgatcgcgttgccgttcatgttcaccggggcggtgagcggagccgcgaactgcgtgccgttcagcgcgccgaggttggtcgacgagaactgggtgatcccgtcctgggcggccgacggagcgaagccgccgtggctgtgcccaccggcctgagccgcggccggggccatcagcagagcgccggcagccatgatcccgacgctcagcgtcttacgaacccacgtcttcttcatgagaaaagtgatgcctttcaaaaaatggtcggcaaggatttccgcatattcaattggctggttccagaacattgttctcggggcgcagcggtgccctggctcgaatgtcggtggccctgacccgctcgtcgacgtgcgcccgtcgcggtgatgatcggtgacagccgtcgtacgattcgccgcttgtccgcaaacggttcaggaatcgtcggccggatccacggcggccaccttgagccgccgggctcatcacgggtcgaactagtcaggtgagacggtcggcgccacggcgtcgttgcgccgggcgtcgacatcgggcgcgaccgggcagcggtggcaggccaccgggccgttcgcggtccccgtcggcagaacggccgacgagccgttctccgtgttgccacccgagccactgctggccgggataccgctgaccgccccgaggttcgtccgcgcgggcgcgggtccgtcgccgccgggcatgtcctggcggatcgcctccggcgcaaccggccgggcggccggggcatgccgatggacgcgtgaccgggacagggccgtgacccgccgggccggtttgtcgccggccggggcacgggtcaccctggtgcccgccctcttcacgaaggtcgccggggccggctcgcccaccggggcgaacgggtgcgacagggcaggcggtgccacggaatcagccgcggggccctcggtcgccggctgccgctgcgcgtccgcggtaccgctgctggaacgcagcggtgcggccgtcgtcggcaggggttcaccgtggggttccgggtcgatcgcgggctcgtcgtgcgtcgccgccggaagcgacgtgacgatgtggtggtgggtctccagcggctggacggccgccttcaggagatcgccgaccgtgcggtcctggttctcgtcgagccaggcgggtgccgactcgacatccccgtcgagcacggccccgagcggttcaccggggcccgcgacttgcgccacgggcgccggctcctcgttcagcccggcgggcttctcggtcaggcccgcggggttttcggtcaggcccgcggcctgcgcgacgggcaccggctcggcaccggtacccgcggcgtgcgcggcggcgccggtgagcagccaggccgccccggccaggccaccgacgacgaatgcacgcaggacccaccgggaaccggcacgtccggcgcggcgctccggccgccgctccgccccctggctgtggggcggcatgagcggggagccgccgggggtgaccggcacggagcgggacgccgtgcgcggcgtgcgctcgaccctccagcccgccatcggatccacccctcgtcgtcggccgcaccctgacaattccggatttccggaaccggcgatatcggccactcggtattagcaacgacgcgagcgagcggaaagtcacgcgagcaaatcagaaaaatgatcgcaggaatcgggcggaaaaatcacacgagacgggtacgcgggccggctcgcagaacgcctgatgaaagcgtacggccgaccaggcgttcggccagttcggcggcctcgatcaacttgtcgagatcgataccggtatcgagtcccatgtcgtgcagcatgtgcaccacctcctcggtggccacgttgccggaggcgccgggcgcgtacgggcagccgcccaggccgccggcactggcgtcgaactcggtcacgcccaggtccagcgcggtcacgatgttggccaggccggtgccccgggtgtcgtggaagtgcagcaggtccggccgcacctcggcgagcaggtcgcggacccggcgcggggtgcccatcccggtggtgtcgccgaacgcgatccggtcggcgccgtcacgccggacccgctcgacgatgccggccacccgctccggggggatgtcaccctcgtacgggcagccgaagctcgtcgcgacgatcacctcgagggtggcaccggccgcgtgcaccagcgggatcagtccggcgatgtcgtccagcgactcctcggtggaccggttgaggttgcgccggttgtgggtgtcgctggccgacaccaccacctcgatctcacggaacccggcggcgatcgcgcgctgggcgccccgggtgttcgggatcagcgcggagtagcggacgtccgggttgcgggtgatccgcgaccagacctcgtcggcatcggccatctgcgggatcgccttcgggtgcacgaacgagaccgcctcgatccggccgacgccggtgtcgctgagcgcgtcgatcagggcgaccttgccgtcggtggggacgggctcctcgttctgcaggccgtcgcggggtgccacctcgcggatgctgatcgcgggcatcacttcacccccttcatccgggcgacgatgccggtgtcgtagtccccggagcggaactcgtcgttctccagcagctcggcgaagaacggcaggttgttcttcggcccggcgatccggaagccggccaccgcgtcccgtgccttggccagcgcttcctcgcggtcggcgccgaagacgatcagcttggcgagcagcgagtcgtagaacggggtgaccgtgttgccctcggtgtacccggagtcgacccggaagcccgcgggctcctcccaggtggtgatcgcgccggggccgggcaggaaccgcttcgggtcctcggcgttgacccggaactcgatcgcgtgacccgactgtccgaactggtcggacacgtcctcgccgctggcgatccgtagctgcgcctcgaccaggtcgatgccgtggatcagctcggtgatcgggtgctcgacctgcagccgggtgttcatctccaggaagaagaactcgccggtggccgggtcgagcaggcactcgacggtgcccgcgttgcggtagttcaccacttcgccggccttgaccgcagcctgcttcatccgttcccgcagctccggcgtgaccgccggggacggggcctcctcgacgagcttctggttgcggcgctggaccgagcactcccgctcggacagcgcgaccacccggccgtcggccaggcccagaatctgcacctcgacgtgccgcacccgcgggaagtagcgctccagcagcaccgagccgtcgccgaacatccgctcggcgaacgcctgtaccttgccgaactcggtgcgcagggcggcctcgtcggtggcgacgcccatgcccatgccgccaccgccggcggcggccttgaccatcaccgggtagccgatcgtcgcggccgccgccacggcgtcgtcgacgccggccaccggctccgcggtgcccggggcgaccggcacgccggccgcggccatcaggttgcgggcattgatcttgtcgcccatcgcggtgatcgcgtcggcgccgggcccgacccagatcagaccgttggcctcgacggtacgggcgaaatcggcgttctcgctgaggaagccgtaaccggggtgcacggcctgtgccccggtctgcttcgcggcggccaggatggcgtcggcgttgcggtaactctgcgccgggttggccgggccgacgcagacggcctcatcggcctcccgtacgaacggcaggtcggcgtcggcttccgagtggaccgcgatggtacggatacccaggcggttcgcggtgcggatgatccggcgggcgatctcgccgcggttggcgacgagcagcgactcgatcatgaggctcctgtatgtcggggtgccggcccgccctgtggggtgaccggtggtccgttttgttctagtcgccggtcaccgcgggtcgcgcggattccagcagctcgtaccttttcagcggccggtcagcgcgtgcatcgtggcctcgcgcagcaggtcggcccggcggcggcgctccacctcgccgcccaggaacggcgtcgagttcatcaggccgaacgcggcgtgcgccagcacccgggcctcagaggcctccagctcgggccgcagcagggtgagcacgccgacccactcctccacgtacagacgctgcaaccggcggatctgccggcgcggctcctccggcaggcggtccagctcgtgcaggtgcagggcgatgaccgccgggttggccagcgcgaagtcgacgtggaagtcgatcaggtcggcgagcgccgcctcggcctcggccgggtgccgggcgacccgctcacggccgccctccagcaggctctcgctgaccggaatcagtgcggcgaccagcatcgcctccttgccggcgaagtggtgatacaacgccgggccggtgacgccggccgccgaaccgatgtcgtccatcgacacgccgtgatagccgcgggcggcgaacagaccgaccgcgatctcgaggatttcgtcgcggcgtgaccgccgccggggcgccggcggggtcgtccggtgccgctgatctaccgtcgtcacctcgtcactttaacgcgtcgtcaagtccttgcttaacggtcgttcagccgatcgacggccgcccgggcctcggcgtacaactcggcgaaccgcttctcctcggggagcgactccatcagagccaacgcctcggccggtcgcccggagcgcaacaacgcctcggaaagcatcccagtcacccggtcggcgtcgtcccgcgcgccgatcgcccgcagccgctcgggcgcgccgtccagatggggcagcgcctcggcccaccggccccggcgcatcaggagattgccgacctcgaaggcgaagatcgcgcgaccccactggacgcccggctgttcggccagttcggcggggagttcctcgtaccggcgggtaaccaggccgatcagctcctcggcctcgtcgacctgatcggcgtagttcaacgccatcagccgccgccgcagcacgcgcagctcgccagccggatcaccggcctcgcgcagcgcctcggccgcggcccggaaggtcagcgccgcctcggcgtcccggtccagcttgtagagcaccatgccggcgtcctcgccgagctggccgcgcccggccgggttgtcggccagcacctcgatcagctggcggtacagctccagcgcccgaccggtgtcgtcaagatcacgataaatgccggccagcatgtaccgcgtgtcgttgagcggctccgggaagcccagtcgctcgaacccgagcaccgcctcctcggccacctcggcggcctccgggagccggccggccgcccggtacgcctgggccagatcctgccgggcgaagacccccggctgctccaggtcgtgctcggcacagatcgcgaccgcctcgacgaagtcgtcgatcgcctcctccggccgctccagggacatcaacgcgcggccgcgcagcgcatggccggccagctcggcgccgggcaacccggtggtcagcgactcggtcatcgcggcgaccacctcggccggatcgtcgctgacctgccccacgatggtggccgcctcggcgctggcccgtgccggaccgtgttcgcgatagaaggaccaggcctcgcgggccgccgcccccgcctcctcgtgccggtgcgcggcgccgcggttccgggcgcgcaccagcgcgtggtacgccacccggcgcggccggcccgactcggccgcatacgcgtcggcgcggtcgccggcctcgttcgcctcgtccaggctgtccgccatgaagtacatcgtggacagccgcagccaggcgttcgcccggtcccgggcggtgccgtgctcctcctggtaggcgacgtcggaccggaccagcgccacgtcgtcggccggctcgccgcgctcggcccgggcccgctcgatcgcgatccgggcgcgcagggcgctgacccggctcccgtcaccggcccgggtgaaggcgatgacggcctgctcccaggcggcgatggtgccgtcgtggtcgtcatcgggcagggcgacgccgcggaacgtccagagccggccggccgccagcgggtcgatcgggtccgggaagcgcttggcgaacgcctccagcaccgcggcgaactcgtcgtgcgcatcgtcgtcgaggaaccgctcggccaggtcgagcagctcggtctcgtccaggtcggccgggatctcgaccggctccggcgtcgcctcccgcaacggcgccaccgccgcggccggggtcggggccggacgacgggcggtcggggcgagcggcaggtcgaccccgtagggttcggcggtcatcgtctcggccaccagtctgccctggtgcccggtgccgttgcgggcgtcgaaccgggcggccagcccggtcgcgtaggtctccagctcggcggccagcgcctcggcggtcacatccggccgcccgctgcgccggatcagcgtgtcgccgtggccccgcgcggcgagccggcgcagcagcgccaccccggtcgcggcgaagtgcatcccggcggacggcgacggcgcgcggtcgagccagtcgatgtgccgctgcaggatctccaggccgcgggcctcgttgccggtccgcgcgcagaacaggatgtggtcgccgatgccggccagatcggccaggttgccgcgctcgaccaggtaggaccggcggtgcgcgtccgcagcgtcggtcaggtggccggtctgcagataggacaccatcagctcgctgaggatgctctgcggctgctcgttgcagttcagctcgccggccagcaccggcgcggacagctcgacggcctccgcgaaccgctcccgggtgttgaggtggatgaccatcgtggtggggtcgcagcccgcgcagtcggagagcgcgttgcgcggcgcggtccgccacttctcgaaccagccctccgcctcctcggtcagcccgagatgccgggcgaccaggtagcggtgtttgtataccggctgcatgccgtgcccggtctcccggtagcggcgctccatgtcgtcgagcaccgcgtacgtccgggcgagcgggatctccgggaaccgggtgagcgcgctgatcatcgtcttgaacagccagagcaggttgtgcgtccagcgctcgtggtacggctgcgggttcttgtcgaagtcggccacgcaccaggagaaggtggcgaacgacttcaccgactcgccgccgtagatgtacgccgtggtcgcgaacagccgggtgtagaaggccagcgccgggtcaccggcaccgtcgacgtgccgcagcacctgctcgaccagggcgatctgggccgcaccgtacggcagatggtgggcctcgtcgagaacgttccacagctcttccgcggtcttcatcgggtcccctcaccggggacggcccggtccagcagaccgaggaacgaggtggtcagcagcgcggcgtcggccggccggatcgggtggtggccgagcagcagcgcctgaccgtagagcgactcgacggccagcgcggccaactccgcgtcgccgagcgcggcgacccggcggatcagcgggttgcggtggttgaggaccagctgcggccggtcgttgggcaccgtcgaggagagcgcgtcgagcacgccgccccacaggtcgtcggcctgatcccggctggcggtgaactcgtcgtggaacgcggcggcccggctgaccaggtagagcgccggcagagtgaccgggtcgaaagcccggaccaccacctcgcagccgagtttgtccaggcggcgctgggcggccgacaggaacggacgcagccgcagctcactctccgcgtcgacggccgtgaagcgggtggtgaggtcggtcggatcgaggcgctcggcgcgaacctcgggatcggtggcggcgagacgctcgatcagatccgcgtcgtacacataaccgccgttgatcagaccgacgtcctgggcggcggcgacggcggcgagctgccggaactcgtcggcggtggccgcgtagcgcagcgcgccgaagcgggcccggaactcggccagggtcagctcgcccatgttggtctgcatcggataccactgctcgaccaggcgcagcatctcgtcgtcgtgcagggccagcgccttcaccccgaggtgatggatctgcaggaactgacccaaccggcgcggatcggtcgcggagagccggaccagccagccacgcagctggtcggcgatcgcctcgcgggtctcggccagcatgccgtcgtcgtagagcgcctcccggctggcggtcggccgcagctcggtgctgtccaccacgcagcgcgcgaagaacgcccagtcgggcagcagcccctcgacgctctccgagagcagcatccgcttgaggtagacccggtggccgccacgactggccgggttcaccggcgtgggcagcacgaacgccgcgccggacaggccggagcccggcacgttcaggtcgatcacgtcgaagggacgaaaacccaggacgctgtccgcgtacgcgttcctctcaccggccgggagcgcccagggcaccgtgccggcggtgacccggcggccgtcgacggtcacctcgaccggcagcagcgagccgtagagctcggccagctcggtcaccgtcgcgccggtcaggtagtgctcggcgccgcgccgcggcagcagggtgaccgtggtccccggctcgcgatcgtcgccgggccgcacgtcgtagcgcccgtcggagtgacccgtccagagcaccggggcggcgccctggcgccgggtgtgcacccggatctcgtcggcgaccaggaagcaggagagcagcccgatgccgaactggccgaggaactcgtggcgggcgaagcccagctcgtcgcgtttcgagctgcggccgatggtggccagcagctcgtgcacctgcgcctcggtgagcccgatgccgttgtcggtgatccgcaggacgggaccggtggtgatctcgacccggccggcgtggtcggggccgaccgcggtgatcgcatcgaccgcgttctgcagcagctcacggacgtagacgcgggggctcgcgtagaggtgatggctgagcaggtcgacgatgccccgtagatcgacctggaacgtgttgctcacggcgcgcacggtaccggttcggtacgacaaaaccggggttatttcggagcggcgcggtgccgggaccacgccgctccggcgggtcagctcaggccacccggctcggtgcccttggcgatcggcgcgcggaccaggttgccccactcggtccacgagccgtcgtagttccgcacctgcggatatcccagcaggtggtgcagcacgaaccaggtgtggctggaccgctcgccgatccggcagtacgcgatgatgtcgtcgcccgactccaggcccagctcatcctggtagatcttgatcaggtcgtcgtgcgacttgaacgagccgtcgtcgttggccgcggacttccacggcttgctgaccgcgcccgggatgtgcccgccgcgcagcgcgccctcctgcggatacgccgccatgtgggtcagctcgccggtgtactcctgcggcgaacgcacgtcgaccagcggtcgcccgccggcgatgtggcccatcacctggtcccggaaggcccggatcgccgcgtcgttgcgcaccggaaccgggtagccggcccgctcccggaccgtcttgtcccgggtcaccggacgcccctcggccacccacttctgccggccgccgtcgagtagccgcacgtcgcgatgtccgaaaagactgaagacccagagggcgtacgccgcccaccagttgaagttgtcgccgtagaacacgatcgtgtcgtcccggccgatgcctttggcctcacacatcgcggcgaacgcggccgggtcgagatagtcccgggtgagctggtcgttgagctccaggtgccagtcgaccttcaccgcgcccgggatgtgcccggtgtcgtagagcagcacgtcctcgtccgactcgacgacgaccaggccgggcgtgtccaggttcgcggcgagccactcggtggtgaccagtttgtcgggatgcgcataggcctgcagcgcctgcgccggatcgttcgcaacggacatgcctgtcacgctagtcctactcagtcgttgatcggggccagcacgggacgcttcgcggtcaccagatcgcccgacgagcgaccgcgcagatgccggctcacccacggcgccaggtgctcgcgggcccagcgcaggtcggcgctcaccgccaaccgccacggcgtgggctgcggagccggcggcaccagcatccactcctcctcgacaccgacgccgagtgcggtcagcacgtgcccggcgacccgccggtgaccggcggcggacaggtgcaggcggtcgtcgctccacatgtcgcggtgcaggtaggcgtggtcggcgaagaggtcgaccaggtgggcaccgtgccgttcggcgatctcccggaaaccgtcgttgaggacggccgcgcggctgccgatcatccgctgcccgcccgggatgtgcacggccacgtcggcgaaccggaacatgatcacgtcggcgccggtggcccggatccgggcgatcaccggatcgatccgttcgaccagggtgtgcggatcgacccggggccgcaggatgtcgttgccaccggccgcgaaactcaccaggccgggccgcatcgccagggccggctcgagctgctcggcgatcacctggtccagcagccggccgcggatcgccaggttggcatagccgaagtcggggcctgagtcgaccgcgagccgggtggccaccagatcggcccagccccggtaggtgccgtccggatactcgtcgcacatgccctcggtgaagctgtcacccatcgccacgaagctgcgccaggccatcacgtccccctaacgtctgctcagcttttgttgctcgatcagctttccacccgatgcacgcacgcggaacgtgacgatggcgacacctagataaggacgtgatttagtcgtacgtggtctctagtctcggtgatcacaccggtgccgacggtgataccaccggggacactggggttgtcgagacgaatgaggggccggagggcagaggcatggccaggcggatagcggacgtgatgacccgtcgagtggtgtacctgcccgccgacacccccctcgacgaggccgcgcaggccatgcgggatcagggcatcggcgacgtggtggtgacccaggggccggccgtgtccggcatcgtcaccgaccgggacatcgtggtgcgtgccgtggccgagggcctggcgccggcgaagaccacgctcggtgcgatcgccacccgggagctgatcatgatcgaggagagcgcgacggtggaggaggcggtgcaggcgatgcggtcccgtgccgtgcgccgcctggtcgtctgcgatgccgagcgcaatgcggtcgggctgctcagcctcagcgacatcgccctgctgccgctgccctccgccgcctgacccggccccacccggctcgcccggtacacgcatggcccgcccggcccgccgggtcccccgcccggcgccgttacgcccgccgccggcgccgcggtccgtcggcgccggactaagttggtcttgtgactgacatgccgccgaagctggccgagatcgtcgaggagttcgcctccgcgccccgcgaggtggtcctggagatgctgctggagttctccgacgcggtgccgcccctgccggccgatctggtcgggcacgagggcatggagcaggtcccggagtgccagacccagttcttcctcaaggccaccgttcagccggacaccacggtgaccacgtggttcgactgcccaccggaggcgcccaccacccgcgcgttcgccgggatcctggccgagggactggccggcgcgtccgccaccgagatcctggccgtgccggacgacctctacgcccggatgggcctggcccaggcgatcagtccgctgcggatccgcggcggcacggcgatcctggcccggctcaagcgccagatcaccgaacagcttccgtaagctcttctgaaacggagaagtgtggacatccaggtctggtccgacgtcgtctgcccgtggtgctacatcggcaagcgccgcttggagaacgcgctggccgatttcggcgagtcggtcaccgtcacctatcgggcctaccagctggacgcctccccggtcccccagccactgccgatcaagcaggcgatggcctcgaaattcggtgacgcggaccgggccgagcagatgttcgcccacgtcacggaaatcggcgcgagcgagggactgactctggacttcgaccgggtggtcgccgccaacaccttcgcggcacaccggctgatcgcctgggcggccgggcatggccggcaggcagaggtgctggacgcgctgcagcgggcctacttcacccacggggccgacatcgggtcactgcccgtgctggcgaagatcgccgcctcggccggcctggacggggcggcggccctgggctacctgacctcggaggccggcacggcggccgtcaccaccgacctggccgcggcacgggagctgggcatcacgagcgttcccacgttcgtcgtcgacggcaagtacgccatccagggtgcccaggaatccgccaccctgctgtccgccctggccgagatcacccgtcgcgaagccgtcgaagccggtcaatagcgtttcacgtggaacgacattgatggaagtccacgtctggccatcgatgtcggccgggactcgggggccgctagccggcctctttggcgagcccctcgatcacccgggcgccgggtagcgcgccgaggaccggaccggccacggcgatcttgctgtgccgcaccccggacccgatgatcacgtgcggcgtggcgaccacgcgggagtcgaccaggatcggccagtcgtcggggagcccgatcggggtgatcccgccatattccatcccggtcagcgacaccgcctcgtccatcggcgcaaagctgcacttgcgcacgtcgagcagccgccgcacggtcccgttcacatcggcccgggtggtggccagaacgacacaggccgcatacctcaccgtctccccgcggcgcccggccacgatcacacagttcgccgactcaccgagcgggatcccgtaggcctcgcagaacgcggcggtatccgccagccccggatcgatcgacgccaccagcacctgatcgacatcgaccggcgcgtcctccggccacaccgaaagcgctttggccaccggcccggccagcagatcaagacgagactgtgcggattcggtctgcaggctccccatcacgccgccatcattaccccgacccgtccccgccatccacaccgccaccacattccaccgctcgggcccggtttcgagagccgtctcctccgcatcgacgggcggctcaggtctcggcggatcatgccgaatgtctgagatcgtggaggaggcgaacgcagcggaacgccgcaaggctcgtatcggcacggtcagcgggctcgcgctgctgaccggcaccaccgcgatggcagcggtcggcggtggccatcactcgttcccggccaccgctctcctcgccctgctggctctcggcatggcccactcgttcacggtggagatccagcgccaggcgcatcgccgcaccggccgctggggccggcccgacacggtcaacaccgccctgctgtccggctgggccgtcgcctcactgaccgtcgccgtgctcccctacccgccgaccgcgatgcgtgtcatgggcctgctgctgaccaccagctacgtcgccgcctgcgcctatttcgtagccgaacgccaccgcgcgacagccgcccgccgctccacgcccccggcaccgcacccccgcgaggacaccgcgatcgaggccgcccacagccttgccaccgccacgctccagcccggtgagaacaccgcgatcgaggccgcccgcaccttggccaccccaacgccgcacccgagcgagaacaccaggcgggagacggcccgcatgtcgctggaagccgcgccttgaacccgcaccgggccggtcgaagatggcgtcccggtcttcgtgcctccgctgcggcaccaatccacgcctaccgccgccggctggcggctactgaccgctgctggctggtggcggtaatccgcaacgggtagccggtgatccgtagccggagaccggtgatccgtgcggaggctggtagcccgtgcgggaggcccggtgggccggtcaggcgatgctgtcgccggccggttggcggccggtggaggccattgtcggcaggaccaccatcaggggcggcaccgccaccccgttcgtttcgatcggtagttccggcaccggcagccagtccaggccgagcggctcgggaccgctgccgtcgtcgggactgacccggggctcgccgtcggccaccgacaccgcgaacaccgatgtcatgcccgacggatacggcatctccaacacataccgcaggtcgctgaccaccaggccggtctcctcgaagacctcgcgccgcacggcctcctcgggggtctcaccgggctctaccccgccgcccggcagagtccaccactcgccgccaccggtgcgccggctgcgctcgtggaccatcagcacccggccgtcccgcacgatcacggcggcggcccgtcttcgttcgctcacgagtacgcaggctaaccgtcggaaaccgcgagcgcaggaatcgatcgctcctctgtggatatccgacagcggcagaacgggcaaatacggaactacgccttcggaacggtgaccagcagataccgtttctgctccagcaacgccccggtcagccggatcccggcacgtttctcgacgagcctgatcgcctcctcggtgtgatcggtcacgtcggtgcccaccaccccgtcccgataggtccggacccgcccccgcccggccctgtcgcatcggcagaccaccacgtcggtaccggcggcgagccgcccggcgatcgccgggtccatcccgaggccgccgtcgaagtcaccatcctggaggatcagcgtccagtggctcaggcgggccatgccgacgaagtaccgccgcccggccgcctcgccgtcccccggtccgaccagctggcgccagtagaccatctcgtgggccttcccgccgaccgtgcgcaccacctgaacgggcttcctgccgcgcaccagggtcaggcagaaaccacgccccagcggcccgtccgctgccgcccagaggtgtccctggtcgccgctcacgggctggagcgccatcgtcgacttcccgcatccggccgacagcatcagcgccgtcgccgccaagagagcccgccgtctcaccgcgccagtagatcacttcgacgccccgaaatccggccacttcgcgagccgccccaccgccgcagccagcggaaagccgcccacgggccgccactgcccgtaccagatcgtcgcgaagaaccacccgcggaccgcaacaatcccgcaatatccatcgaccaggaaagcgcgacctcacgaatgtggcgccgtcgaagggggcgccttccggctcaccttgacgccgattgccgggcccgaaaaccttcggccggatcggccgcgcgcgcggccaccagacaggtggcggcgaccgccacctcgatcgccgctgcggcacaggccgtggcgaacggcaggccggcgtcgctggtgcacacgtcgaaccaggcgtcggcgcacatcagcgtggcggtcgcgacggcggccggggtgacccgccggtcacgacggcgggccagccagctggtcgacgcgaggcccgcgatgatcgcgacgtccaggccggcccagacgatgttccagtgccgggccgtggcggtgcgcggcaggagggtggcgaggccgatggtccagggcacgagcgccgccgcggccaccgccggtacgaccggcaacgagattcgatccatgccgtccagcgtgtcggccgtcgcggccggtgtcgttggcgccggcatccgtcttgggggtggcactgggtacagggcggatccggtaatcagcgggatcctgcggccggccgcgactggctagtgtggacgcgtggtgtgggggaacgtgccggcggtgctgtggtcgcgacgcacgtggccggccgtcgccggcctgctgatcggcgcggtcctgtggctcgtgccggccgccctgacgatgaccatcgtcggcgccgggatgctgatcgggtcggagcacccgccgccgggactgggcggctcggagaagctgggcggcacggtcggcgggacggtcccgctcgtcgtggtgctgcccgtgctgctcgcgctgaccttccggttcacggtgtggcaccaggcccggctccgcctcctcggtgccgacctggcaccgcccgccgcgcggccgcccggcatgtcgcgccggagttggctggcccgtcaggcggtgtccgccaccacctggcggcaggtccgctaccacgcgctcggcggcgcgttcctgacagcggccggcgtcgtcgtgctggccggtctggtgttcggccccggtttcgtggtggccgcggcgctcagcggcaagggcagcctgctgcagcggtcgccgatcgcggccctcggcgtgggcatggcggtcgccgcgggttggctcgcccggggtgccgccgccctcgacctggcgctggcccgccggctgctctagctagctagcggcgctctcggccagccgggccgccgttgtcgaggcggccgacgccgagcgccgtcgcatcgagcgtgacctgcacgacggcacccagcagcgcctggtgtcgctggccatgaacctcgggatgacccgcgccgcggtcgccgacgccgatcccgcggtgcgcgcggccgtcgcggcggcgcacgaggaggcgaagcaggcgctcgccgagctgcgcgacctcatccgcggcctgtacccggccgtcctcgacgagctcggtctggacgcggcgctgtccggcatcgcggcccgctccccggtgccggtgcgactggtggtcgacctgcgcgggcggccgccggcgccgatcgaggcggtcgcctatttcgtggtgtccgaggcgttgtccaatgtggccaagcacgcggccgcgacccgcgccgatgtcgtggtgcggcagcagcccggcggtctcaccctggccgtcgccgacgacggccggggcggtgccgacccggtgcgcggcaccggcctgcgcggcctgcgccagcgcgtcgagtcggtggacggcacgctcagcatcgccagcccggccggcggcccgacgtcgatccgggtgtccctgccgtgcgggtagtgctggccgaggattcggtgctgctgcgcgacggcctgtcccggctgttcgcctcccgcgactgcccggtcgtcgccgcggtgggcgacgccgaagcgctgctgcgggccgtcggcgagcaccggcccgacctactcgtagccgacgtgcggatgccgcccggctacgccgacgaggggctgcgcgccgcgatccaggtgcgccggcagtggcccggggtgggcgtgctggtgctgtcccagtacgtcgaggagcggtacgccaccaagctgctcaccggcgacaccagccggctcggctacctgctcaaggaccgggtggccgacgtcgacgacttcgtctcggcagcccgccggatcgccggcggcggcacggtgctcgaccccgaggtcgtgtcgcagctgctggtgcgccgcaccggcccactcgaccggctcaccccgcgcgagcacgacgtgctcgccctgatggccgagggccgatccaacgccggcatcgccggcgccctggtggtcagcgagagcgccgtggccaagcacgtgaacggcatcttcgccaagctggggctcgccccggcggacagcgaccaccggcgcgtgctggccgtgctgcgcttcctcggcggctaggacgaatcactcccgcgaaggcggccccgcccatccgtggcattgcgcgagcccggtggatgagttgacggatcgtgactatggcgactgtcacgcgtcgttattcatcaatgttttagcccgtagcggcggatacagctgaagcttttgcccgaaatctgcccgctcggccacccgccgcttgccgacctggatcagggtgggcgcgccctggggacgatctacgcgtcgaaagccgcgctgacgtgctcaaacacccgattgccgactgctctcatgatcgtaactatgagtaggcaagtcattcacactcatgaccggtagatggggatatcttgaagaagctgaagcgtctcggtggccgtgcgatcgcggtgacgacgagcgccatggccgttgcgacagccgtcatggtggcacctgtcgccgcgctggccgacagctacgcgccgtgcaacaccatggaatccacagtcaaggccggtcagacatccaaggcccagtccattacctgcgtgcagaagccgacctgcggcgaatcttggggacagatctacgacgtcacgtgggacatggtggttcacaccggtggtgtcacggtcaagtcgatgaagatccacgtgacgcacacccggggtgaggacatcaccctcggcgtgaagaacatccgcggcaccaacgcggacatcaatatcggtgggaaagatctgattccggccaatcagaccagctggaccaagacctacgacatcacggacaggtacttcgcgaagaacagtctcggcttcgtcgacttctggctcgcgatctcctccgacaaggccaacggctgtagcggtagctcgacctggctccgctacgggctcaagatcgcctgacaactgtcgcctcgagcggctatgaaaaatgcggatcggcggtctcttcgccggtccgcattttcataccgaccgcgccgcgagcgccgtcggtgccgcgctcaaagcggcggccgggaaccggtgggacctggaatgtgatggtcccagagcggcccggaagatctcggccttgcgttttgcctcgtgaaggcttgaagtgtggagcccaggggacttgaacccctaacccccgccttgcaaaggcggtgctctgccagttgagctagggccccggactgcgcctcagcgcaggtcaggagcggtggtcgcctcgtgccagagggcacgctcgtcgctggaggccttgaccttcttcaccacgagggtggcggcaccgacgaccgctgccacgatgaggagtttcttcagcatcgacaaacccccagtccgggaactcagacgcgtaagagcgaggagccgagcaacgaaacaggcgaccccgtccgcaatttcgcggacaggatcgcccgattgctcgtggggctagatggaatcgaaccatcgacctcagagttatcagctctgcgctctaaccgactgagctatagcccctcacctgcggaacagaacgttaccgcatcgggttgcgacccaccaaagcggggggtggctcgcaacccgaccgggaggtcagtcccgttccgccagggtgagctcgatgccaccgaccaggtcggcgcacacgttgtagatgaacgcgctcagcgtggccagggccgtgaagagcacgacattgaccgcgccgatcagcatcgacgtgccgatcacgccccaggcggtgatccggaagccgctggacgggtcggtgccgccgccggcggtgaccagctcctgcaggctgctgttgaccgaggtccacacgcccatcgtgtcgagtgccaggtagagcaccgaggtcgcgacgaccaccacgatgaacagcacgatcgaaaccgcgaacgagaacttcatcacggaccaggggtcgatccgcttgaggttcagccgggcccgccgcggaccgcgtgcggcggccggagacaccgtgctgcgggccgaacggaccgcctcggagacccgggccgcccccaccgccgacgtaccgctctgctggcccgtgggcgcggcggccgagccggtggccggcgcggtccgctgcctagctagctagcgtcgccggacgtgcggcggcggtcccgggcgcggcgcccttgcccttggtcacgaccggaacggccgccgaggccttggccacagcggggccgcccgggcgcttggcctcggtgtcctgtccggcagcgggctcaccgggcggcggggccatgcccggcgcccgggtgaacttcggcggggacggggcttcggcggggacagcggcgcgcccagcggtctcgcgtccagtcgatgcggcatcgtccttcttcgccgcatcgcccggagtcgctgaggtcccggggcccccgacttcgcctgtgtctccggcatcaactagtcctgttcgtcaggctcgtcggcattgcgagcaagcgccacgatggttacaccttctgggaggtccatcagcttgacccccattgtgttccgatcccgtgtgcgccgtacaggcttcacgggagtccggatgacaccaccattgctggtgatggcaaacagttcatcctccgggctgatcaccagagcgccgacaagtccaccacgacgttcggtgatcttcgcggtgagcacccccttgccgccgcgtccctgcaccggatactcctcgatcggtgtgcgtttcgcatacccaccgttggtggcgaccaacacatccatgccctcgcggacgacctccatggcgaggagctcgtcgttgtcgccgaagcgcataccgatcacaccggacgtcgcccggcccatcggacgcaacgcctcgtcggtcgcgttgaagcggatggcctgggcgtgcttggacacgagcaggagatcgtcctccgaagccaccagagccgcgcccaccaattcgtcatcctcccgaaggttgatggcgatgatgccaccgctccggttggagtcaaattcgtcgagccgggtcttcttcacgagaccattcttagtggcgagcacaaggtacggcgcgacctggtaattcgggatctggatgacctgggcgatgtgctcgtccggctggaaggccagcaggttcgcgacgtgctgtcccttggccgtacggttcgcctcgggcagttcgtacgccttcgcccgatacacccggcccttgttggtgaagaacagcatccagtcgtgcgtggagatcacgtagaagtgcgacacgatgtcgtcctggcgcagggtcgcgccgctcacgcccttgccgccgcgcttctgcgaccggtacatgtcgaccttggtgcgcttggcataaccggttcgtgtgatggttaccacaacgtcctcgcgcgcgatgaggtcctccatggagacctcgccgtcgaacgggatgatctgggtacgccggtcatccccgaacttctggacgatttcgcccagctcctcggaaatgatcgcccgctgccgctccggcttcgccaggatgtccttgaagtcggcgatctcgatctcgatcttggccagctcgtcgacgatccgctgccgctccagggcggccaggcggcgcagctgcatgtcgaggatcgcggtggcctggatctcgtcgacgtcgagcagcgtcatcaggccctggcgggaatcctccaccgtgggcgagcgccggatcagggcgatgacctcgtcgagcatgtcgagggccttggccaggccgcgcaggatgtgcgcgcgctcctcggccttgcgcaggcggtacgcggtccgccggcggatgacctcgatctggtgctcgacgtagtagcggatgaactgcgccaggttcagcgtccgcggcaccccgtcgaccagcgccagcatgttggcgccgaaggtctcctgaagctgggtgtgcttgtagaggttgttgagcaccaccttggcgaccgcgtcgcgcttgagcaccaggatcagccgcatgccggtacggccggaggactcgtcccggatgtcggcgatgccggtgagcttgccctccttgaccagctcggcgacccgctcggcgaggttgtccgggttgacctggtacggcagctcggtgaccacgagacagggccggccacgctggtcctcctcgacctcgaccacggcgcgcatccggatcgagccacgaccggtccggtacgcgtcctgaatcgcctgctggccgacgatcaggccgtacgtggggaagtccggacccttgacgatctcgatgagcgcgtcgagcgtggtggcctcgtccgcgtcgatgttgtccaggcaccactggacggcggccgcgatctcccgcaggttgtgcggcgggatcttggtcgccatcccgaccgcgattccctccgagccgttgaccagcaggttggggaagcgcgacggcaggatggtcggctctttggtacgcccgtcgtagttgtcctgcatgtcgacggtgtcctcgtcgatgtcccgcagcatctccatcgccagcggggacagcttcgactcggtgtagcgcatggcggccggcgggtcgttgcccggcgagccgaagttgccgttgccgtcgatcagcggataccgcagcgaccagggctggcccatccggaccagggcgtcgtagatcgacgagtcaccgtgcgggtggtagttgcccatcacgtcgccgaccacgcgcgcgcacttcacgtacccgcggtcgggccggaagcccgagtcgtacatcgcgtacaggatcttgcggtgcacgggcttgaggccgtcccgcacgtcgggcagcgcccggccgacgatgacgctcatcgcgtagtcgaggtacgaccgctgcatctcgacctcgaggccgacaggctcgacgcgctgcgtcacgccgccgccggtctccgcggggatctcgtcgccgtcggggggttcgggtgtgtcagtcactgttaacccttactcaaggtgaagccaggcaaatccggtcaaggtacgcgaattgctgtggataacgttgtggaaaggtgccctacgctgtggacacgtgcccagcagcgcgagccggcggatcagatgtcgaggaacctgacgtccttcgcgttgcgctggatgaaggagcgccgcgcctcgacgtcctcacccatcagcacgctgaacagctcgtcggccaccgcggcgtcgtccagggtcacctggcgcagggtgcgggtgtccgggtccatcgtggtgtcccacaactcgtggaagttcatctcgccgagacccttgaaccgctggatgtcatccggcttggcgttcggcttcttctgctgacgcagcgcgatcaggccgtcccgctcccggtcggagtacgcgtattgcgcgtcgtcgccccgcttgttccacttgagcttgtagagcgggggcgaggccaggtagacgtgcccctgctcgaccagcggccgcatgaagcggaacaggagggtgagcagcagcgtctggatgtgctgcccgtcgacgtccgcgtcggccatcaggatgatcttgtggtaccgcagcttgccgatgtcgaactcgtcgtggatgccggtgccgagcgcggtgatcagcgcctggacctcgttgttcttcagcacccggtcgatccgggccttctccacgttcaggatcttgccgcggatcggcagaatcgcctgatacttgctggaacggccctgcttcgccgagccacccgcggagtcaccctccacgatgaacagttcggtctcgcgcgggtcggtggactggcagtcggccagcttgcccggcatcgagccggactccagcagcgacttgcgccgggccagcttgcgcgcctgctgcgcggcgatccgggcgcgggccgcctggtcggccttggtgatgatcaggcgagcgtccgccgggttgcggtcgaaccagtcggcgagctgctcgttcgccaccttctgcacgaagctcttcatgtcggtgttgccgagcttcgtcttggtctgaccctcgaactgcggctcgcgcagggtcaccgagatgatcgcggccagaccctcccgaatgtcctcaccggacagcttctggtcgcccttgaggaatttcttctcgatgccgtatttgttgacgatcgtggtcaacgcggcacggaagccctcttcgtgggtgccgccctcgtgggtgttgatccggttcgcgaaggtgtagaccgactcgccgtacgactcgttccactgcatggcgatctcgacgcccatgccggcctcgttgtcctcggcgccgaactcgatcacggtcttgtggatcgcgctcttggtcgcgttgaggtgccggacgaagtccgagatgccccccgcgtacatgaaggtgaccttgcgcggctcaccgttctcgtccaggaactcggggcgctcgtcggtgaagttgatggtgagcgcgcggttcaggaaggccatctcctgcagccggcggtagatcgtctggaagtcgaactcgaccgtctcgaagatcgccgggtccggccagaactgcaccgtcgagccggtcgtctcggtggcctcgcccttgatcagctcctccgggacggaggcgttgtacttctgccgccagacaaagccgttcttgtggatcttcactgccatccgggtggacagcgcgttcaccaccgagacgccgacgccgtgcagaccaccggagaccttgtaggcctggttgtcgaacttgccacccgcgtgcagcacggtcagcgccacctcgacacccggcttcttcagcttcgggtgcaggtcgaccgggaagccacggccgttgtcggtgaccgagacaccgccgtcggccagcaggatcacgtcgatcgtgtcgcagtaccccgcgagcgcctcgtcgacggcgttgtccacgacctcccagatcaggtggtgcagaccccgctcgccggtggagccgatgtacatgccgggacgcttgcgaaccgcttcgaggccctcgagcacggtgatcgactcggcaccgtactcctgattgttctctgccatcctcggccgctttctcgcaccggaccccaggggccccgcacggggttggcaggcgcccagcaacgatcggcgcgcaggaggcaccggcctgatgacgccgcggggagagcggaccaccggtggaaccatgcacgccggtcgccgcggacggcccgcggatcgtgatcggctggaaaaaccgcgtagcgtgacgaagatggctgcgtgtagcggcctggacaccgtcaagcacagttttcccggtcaccgtcgattctactccgccgagtcgagttggcgagggtccggcaccccttccgggtgcctgagagtcccgtagcgcgatcgagcccggctcccacgtctccccctacacggagcagccccctcgcacaacggcaaacgctgtgggccgggcgcgcctgccgggtccgaccggcacgcactgccacactgcctgtcaacggcaggcgccggtgtcgtaacctcgcccgcgcgggccgtgcatggccgaacggaccgcatggtcaggtcgaggaagggttgccccgatggcgcacgacaagggcctggacaacgtcgcggtgcactggccgcggacgaaccagtactacgacccggtggctcccgccgagttcgtggacttcggcgcgatcgccgacgctccggagatcgccgcgcccaccggcgcgctggcgctgcacatcgccaagaccggcacggtccgggccaccgcgtacaccgaactggtcgatctgttgctcggtctggagggcgtgctctacgccaccgacgcggccgccgaggacgaggacccggtgatcgacccggacggctgcgcgtggatcgcgggcggcctggagcggttcgtcgagggccacgagaagttcggcgacctggtcaccttcgacaccgtggccgaggtgctgcggaccgcgatcgccagcgggcggctcgccgagcagcagctgcggtggctcgaccaccggctggcggcgctgcgggacgacgccggcaacgcgccgcactggagtttcgcgcgcaccgagctggcggtgctggccggtttctaccgccgatgcgcggagcggggcttcgccatcttcgccgactactgagccggccgcgtcgagcagggagcggcccgggtcgcaggcgggtgggaccgcgcggcgatcacggaagcggaccgcgccgcgatcaggcgacgggtgacgatcgtttccggtcagcggccgccgggttggccggcgtggtctgcccgttgcggcccagccaccacatctcgccgccgatgatcagcagcagcaccccggcgcccgcgcccaggaacagcgaccagcgcatgccgtcccagacccggtcgcgggccgcgaggccctcgtgctggcaccgagccgccgtggcctggcacggcaccgaccgggtggcagccaggaccgggctcgccgcgaagggaaccgagcccagcacgagcatgagcagaacgaccaaccgccgtcgtaggaccatgatgactaggacgctgcgaaaccgggattggttgcacgaacggcgggaagtttcacgaaagtcaccggcctctcggggagaaccgggcggacccggaggaaaacgtcagccgtacgtgtcccgcgggccgcggccctgcacccggcgcgggccgcgggaccaggagggcgccgccggaccgtggatgttgagccgggtcaccacgttgtggccgacctcgccggcgatctgcttcagcagccggccggaaagcatccggagctgggtggcccacgccgtcgactcggcctcgacggtcagtaccccgccgtccagcttgatcgggcggctgtgcgcggcgatgtccgcgccgaccaccttctcccaggagccgaagacggtcgcctcggcggtgggccgctcccagccgcgcgtcttcatcagccgctgcagcaccgtgccgaacagctgcgggtcgcgcgggtcaggcccgggaccggaatagccgcgcagccgcttctcaccaccgccgccggtgcgccggcgcggctgccgggaattctcccgccgtttcgcgagagccgcgtcgagcacggcacgggccagctccggtccgcccttggcggcctcagcagcagggctcatctcgtccggcacagcacccgacccccctgtggacaagccgacccagagaccttacgccgggtggggagcggcgccggcacgcgatcggcggggccggatccgcaaaccgcccgaatatccacaaaccgcgcccgagttttccacaggctgtgtggtcagccggcctgatcgaccgagccgagggtcacggcgaagcgggcgccccgcagcgcggccggcacgtcctcggccaccgcacaggtcaccagcagctgggcagcgtccgacacgagcgcggccagccgatcccgccggccggcgtccagctcggcgaagacgtcgtcgagcaccaggatcggctcgatgccgtcggagcgcagcaggtcgtacgccgccaggcgcaacgccagcgcgaacgaccacgactcgccgtgactcgcgtaccccttggccggcatctcaccgagcgccagggtcagatcgtcgcggtgcggcccgaccagggtggtgccccgctcgatctcggccggccggcgctcctgcatcctcgccagcagcgcagcctccagggcgccgcgatcggggacgagcccctcgcccaggcgggaggcgtacgcgatcgacgccgccgacctgccggccgcgaccgcgtcgtacgccttggtcaggtgcgggccgagggcggccgccagctccagtcgaccggccagcagctcggcgccgtgatatgccaggtgctggtcccagaccgccagcgtcgacagatcctgaccccgggtcccgccgaccttgcgggtcagatatgccgtccgcagcagggcgttgcgctgcttgaccacgcggtcgtaatcggcgcgcacccccgcgtaccgcggctggcgggcgaccagcaggtcgtccaggtagcgccgacgttccgacgggtcgccgcggaccagttccaggtcctccggggcgaacagcaccatccgcagggcgccgagcacctcgcggggccggcgcaccggcgatcggttgagccgcgcccgattcgcccgccctggcacgatttccagctcgaccagcagctcgcgaccatcgtggacgatcgcgcaacggaccaccgcggaggtggcgccgaaccggaccaggggcgcgtcggtggccacccgatgactgtccagagtggccacgtaaccgagcgcctcgatgaggttcgtcttgcccatgccgttctgcccgaccagcacggacacgccgggatcgaggtcgacggccacccgctcgtaggaacggaagtcgacgagctcgacccggcgtacgtgcatggatcagcgcttgacggagtggccgccgaactggttgcgcagcgccgccaccgccttcatcgcgggcgagtcgtcctgccgcgaggcgaaccgggcgaacagcgatgccgagatgacatgggccggcaccgccaagcggaccgcctcgtcgaccgtccagcggccctcgccggtgtcgtccgcgtaacccttgatcccggccagtttcgggtcctcgtcgagagcccggtccagcaggtcgagcagccacgacttgacgacgctgccctcccgccagctcttgatgatcgcgggcacgtcgtcgacgtgctcggaggcctcgaggatctcgaagccctcggcgtacgcgtgcatcaggccgtactcgatgccgttgtggaccatcttggcgtagtgaccggcgcccggtccgcccgcgtgggcgaagccgaactcgccggccggcttgagcgcctcgaagatcggcatgcagtgcgccaccgtctccttgtcgccgccgaccatcagcgcatagccgttggtcttgccccagacgccgccggagacaccgacatccatgtacttgatgccctttttcgccagccgctcggcccgcggggcatcgtcggtgaacttggagttcccgccgtcgatgatgacgtcgccgggcgagagcacctcggcgagcgcgtcgatggtgtcctcggtgatcttgccggacggcaccatggtccacaccacgcgcggcgtggtcagcttttcggccagatcggccaggctggtggcgtcgctcacatccaggttctggtcgtatccgacgacctcgtgcccggcagcacgaagccgttcccgcatgttgccacccatgcggccgagaccgatcaggccgagttgcatggtcttccccctagaagtgcgaatgttcctcgctcagtatcagcgggttacccggatcggcatgatcagatagcggtatcccgggatgatttcgccactttcgccagcgggcgagatcacagccggcttgaacgcgtccacgaacgaaaacaccgcggtcggcgcgcccaggttctgcaggccgtcgatcaggtattgcgggttgaagccgatggtcagcgcctcaccggagaactccgcctccatcgcctcgctggcccgcgcctcctcggtggtgccggcctcgacgaccaggccgtcctcactgaagctcagcagcaccggggtggtgcgctcggcgaccagcgcgacccggcggacgacctcgaccagggcggagaccgcgatccgggcctcggcgttgtgcgcggcggggaacagcgagcggaccggcgggtagttcgccccgtcgagcaggcggctggtggtgcggcgggcgccaccggcgaaaccgatcatgccctcgcccgcgttgccctgcgccagggccagggtgaccgcgccgcccagcgggcccagcgccttcgccgtgtcgttcagcgtcttcgccgggacgagcgcgttgaggctgatctccgggtcgtccggggtccactcgatctcgcgcatcgccaaccggtaccggtcggtggcgagcatcgccatggtggagccgttcagctcgatccggacgccggtcatcatcggcagtgtctcgtcacgcccggcggcgatggccacctgggaaaccgctgaggcgaacgtagcggcgtcgacggtgcccgcgctggacggcatatccggaagggtcggatagtcctccaccggcatcgtggggagggtgaaacgcgcactgccgcagacgagctccagatgcgcgccgaccgaggcgatgtccaccggcttgccgggcagcgccttggtgatctcggcgagcaggcgcccggagaccagtgcggccccgtcggcgtccgcctggacctcgaccgagacctggctggagacctcgtagtcaaagccggagacctgcagccggccgtcggtcactcgcagcaggacaccggccagcaccggcactgacggccggctgggcaggctcttggctgtccaggccacggcgtcggcgagcgagtctcgctccacccggaacttcatgctgtcctccgcgatgcttcctctacggggcgtacgagccctctgaaactctatggcgctgacggtgttcacgtgtgcccgaccccggggtgctccgggcggagccggatcgcggcgccggagcagggtcggcgatgggccggcgcgcgccggtcggacatcggatcgcgctccagctttccgatgatccgctttcctgtctccgatgtgacgccggtcggacagcggggcggcggtccgctcccacccctggctcctggtgctgatccacccggccccgcttcggtccggaagcggagcacgcacaccttccacaacgctgatgattgctttttgttctcttagagagataactagtcgtcttcatcggtcctgtgcaaactgtggagaacctgcgtttgcgctggtgagagagttatccaccggtgattcacatgtgggtaaccagggtataaaccggggtctgcgtccacagccgcgaattttcgaggcgttgtccaccgttgtccccaggctatccaccggttatccacggggtttgtcccccggcctgtggacaacggcggaggcccggcgtcgcgttgtccccagaaccttcaacaggaaatccacactcctccacaggcacgtgtataacgcgtgactctccgtgtctgtccacatcgatttccacagaagttgtccacatctgtgatttgcgggctctcggttatccaccgtctggggagagagcctgtggatgcctgtggacgagtgtggataacgttggcacgaaacgtacccgtcctgacgttgacaactttaggttttccgccctaaaaagttgacatggatcaacttcgatatttccagttcggggccgaatctgggggtaactctgtggacaaccccgtgtaaaacccgtggataactgctggggataccgcgttgtcccagttcaatggccattgtcaggtgcctgtgaggaaacttggacaacctgtgtataacgcgattcggcgccgtttgtccccaggtcgctacttgatctccaggcggcggttatccaccggggcaggaggctgtggatgtatgcgaccggctgcggacggggccggggaagcgtggccggttcagcggtggaacccggggtgacgttccgccttgcgagtgaccggcccggggcgccggctgccatggcggcaaggaggggacccggcggggctgctcatccgcgtaccccgcaatcggcctcggaccggagcgacacccggacgcccgcggcggccggcaccggccatggcgccgggagaccggcgacggccgtgccggaggccgccaccgggagccgggtggacctcagctgttctgcttgatccggttggtgagctcggcgatctggttgtagagcgagcggcgctcggccatgtgctgacggatcttgcggtcggcgtgcatgaccgtggtgtggtcgcggccgccgaaggcctgcccgatccggggcagcgacaggtcggtcagctcgcggcacagatacatggcgacctggcgcgcgttgaccagcacccggctgcgcgagtgcccgcgcagatcctccagggagacgccgaagtagtccgcggtcgagaccatgatctggtcggcggtgatctccggcccggcgccgtccggcatgaagtcgcgcagcacctcctcggccagcgagagctggaccggggaacgggtcaggctggcgaacgcggtgacccggatcagcgcgccctcaagctcgcggatcgagttggagacccgggacgcgatgaactccagcacgtcgtcgggcgcgtacatgcgctcctgggcggccttcttctgcaggatggcgatacgcgtctcgaggtcgggcggctggatgtcggcgagcaggccccactcgaagcgggtgcgcatccggtcctcgagggtggccagctggcgcggcgagcggtccgagctgatcacgatctgcttgttcgcgttgtgcagcgtgttgaaagtgtggaagaactcctcctgcgtccgctcgcggttctccaggaactggatgtcgtcgatcagcaggatgtcgacgtcgcggtagcggcgctggaacgcctgcgtcttgtcgtcgcgcaggctgttgatgaaatcgttggtgaactcctcggtcgagacgtagcgcaccgagcgcgcgtggcccagggtggtggcgtagtgaccgatggcgtgcagcagatgcgtcttacccagcccggagctgccgtagatgaagagcgggttgtacgccttggcgggcgactcggcgaccgcgaccgacgccgcgtgggcgaaacggttggacgagccgatgacgaacgtctcgaacatgtacttcgggttgagccggttgccgtcctgcccgccggggcgcggggacgagccggggccgcgcgggtcgagtggcgcgcgaccgggaccgttgtcaccgcgcatcggcatcggatcgtcgcggcggtcgtccggacggcgctggttgtcgcgcaactgggccgggtcggccggcaaccgcaggatcgcggcttcgttcggcgccgggtccgcggtcttctccgtcggacgggcggcggtcggccgctgcggctgcgccgccggcggcatcgggtcggcgaacagcgcttcctggccgtcgctggccggaggaacattgcggacgtacggtgcggccggcgccgagtgctgcgcggaacccgtcggatacggctccggcgcgcgttccggggggccgaaaccgggctgctgatagtgctgttcagccggatatgtgggcagctcgggctggtacggcctagggtcgggggtgcgcggcgggtcggcgtagtgcagcggctgcgcgtcacgcggggccggctgcgcctcggcctcgaccggcgtgccgtaaaccgtgccggggatgccgctgccgtcctcgggcgggcggaccgtgacggccacctggatcggccggctcagcctgcgggtgagcgcctcggtgatcgccgggcgcaggcgcagctcgatcacatcccgggtgtacgcgtccggaactgacagcagcgcggtgtcctcgacgatcgcccggagccgggtgaatcggagataggcacgctgctgccgggaagcgatctcctcggacaattcgctgagcgtgtcctgccacagcttgcccaggtcgacctgatcggccaccgccgcgccacccccatcgccaccgacccccggtggaccttgtgtccggccttcccctgcctgtcggcgtccccgagtcaagcacggtgccatcggctatccacaggttatccacaacccgtggtggtgccgaacggcgctcccgccagagcctgtggcggcgcggtgtgaaacaggctcgccgaggggaacgatccacccgcttgtccggttttggccgctgcttcgcggtatgcgaacggccgggaaagaccagcaaccgggcacgctaacagcggcgggcggggtactacaaccgccgtcccgcgtgcgccccagaaaagatccactttgtgcgtgttccctgacgcgcggtcaggatatggttgaccgctgtaaccgccctgcgtagggttgagcggttgctccgcggccctctgataaagtggcttcttgcagcggatgccccctgacgtagttgaagacggagttctgacgtgagcaagcgcacctaccagccgaacaatcgccggcgcgccaagacccacggcttccggctgcgcatgcgcacccgtgccggccgtgccatcctgtccgcccgccggggcaagggccgcgacaagctgtcggcctgagccggcgcttagtcgggtcggaatgtccaggtagtcgtgctggccgcgacgcagcgactgcggcgtagcgcggacttcgccgcagcgattcgcggtggccgtcgagccggccgcgggaccctggtcgttcacctgcttatcgaggagccggcgcacgcctccgaggcgcgcgccggcttcgtcgtatccaaagcggtgggcaatgcggtggtccgtaacaaagtgcggcgtcggctgcggcatctggtccggccgctgctcgccgacctcccgccgggtgctctgctggtggtccgggcactgcccccggccgcgcaggcggggtacgccgaactcggcatcgacctggacggcgcgctcgcgtccgcccggcgtccccggcggccgcgatgagcctggctgcccggctcctgaccgccgcggtcgtcgcgtaccgtcgatacttgagtccggcgttgccggcccgctgtcggttctacccttcgtgcagcgcgtacgcccaggaggctctggcgcgacacggtgcggtgcgggggacgggcctggcgatctggcggctcctgcgttgccatcccttccaccctggcgggtacgacccggtgcctgacccgatccgtcaccgtcctgccgatgtgactggagcttagattgagtctcgactggatctactacgccatttcgtggatcctcctccgctggcattcgctctgggacgcgatcggtattcccgacgaccgcgtgctcggcacgaactggtcctgggtcctctcgatcttcttcctcgtggtgacgctgcgcgtcatcctcttcccggtcttcgtcaagcagatcaagagccagcgggccatgcaggcgctgcagcccaaggtgaaggcgctgcaggagaagcacaagggtgaccgggagacgctccagaaagagatgatggagctctacaagacggagaaggcgaacccgctgatgggctgccttccgatgttcttgcaggtgccggtcttcatcgggctcttccacgtgctgcgtcacctcaacccgaacctgccggagcacctgaagacgatctacggctggaagctggagcagttcaacagcgcgaccgcggcgcacctgttcaacgtgccgatcagcgccaagttcgggtcgaccccggccgagctggccgcgatgcacgccaacggcaccacggtgaaggtgctggccggtgtcctgatcctggtcatgatgggcaccaccttcctgaccagccggcagatgatcctcaagaccggctgggccgaggacccgcagcagaagatggtgcagcggctgatgctgtacggcatcccgtgctcgctgctgatctccggctcgctgttcccgatcggtgtggtcatctactgggtgaccaacaacctgttcaccctcggccagcagcagtgggtgctgcgcaagttcccgccgccgaacatggccggcaagggtggcgccaccacggcccgcccggcgaacgcgaccgccagcgacgtgaagaacccggtgcagcccggccgcagcggcggactgttcggtcgcaaggccgtggccgaggaggccaccccggtcgttgacaccaaggcgctggccccgaagccgggcgccaaaccggtgaatccgaagaagggcgcccggccggcgaacaaacccaagggatgatcgcggcgcggggccggttgatcgtcaggccccgcgcgctccccttgctacagacctccccgcgatacgtacgcatgtcggcggcgcgggaaacagcggaccgatcccggtcggtccggcccgagtgacaacggagatgagaccgtgaccgacaccagtactccccccgcctccgaatcgccggcgccctcggcggtcgcgccggagacggatgccgcgccctcggaagcggtatcggcggagggtaagaagtcggagagcgtcgcgtcggacagcgacctcttccggcagagtgagatcgccgcggactacgtcgaggggctgctcgacatcctcgactatgacggcgacatcgacgagctggtctccgccggccggccgatggtcgaggtcgtcggcgggcggctgcagccgctggtcgggcagcgcggcgcgacgctggaggcgctgcaggagctgacccggctggcgatcttccgggcgaccgggtcgccgagccggctgctgctggacatcggtggctaccgggcgtcgcggcgcaaggagctggccgcggtggcgcgcaacgcggtggagaaggtcaaggagcacggcgaggcggtccggctggagccgatgtcggccttcgagcgcaagtgcgtgcacgacgtggtgaacgccatcgccggcgtgcagagcgagtccgagggcgtggagccgaaccggcgcatcgtggttcgtgcggcggagtgagatgacggacccacgcttcggcgcgggtgagggcggcccgggcgttacggcgcccgggccgccctcgtctcgcggcccttccggttcgtatgccgcccgtcccggccttcccggcgcggccggggtgccggtgcccgccgaggagcctgccgacgtcgacgtgttgcagccccctgctgtcatggagatggctgctcgtgaggttttcggggaccggctggcgctcgccgggcggttcgcccagctgctggcgaccgagggtgtgttgcgtggcctgatcggaccccgggagacgccgcggctctgggagagacacctggtcaactgcggagttatgtcgcagctgttccctatcggcgcttcggtggttgacgtcggctctggcgctggtttgcccggtatcgtgctggctgtggctcgaccggatcttgagatcacgctggtcgagccgctggcacggcgtaccgccttcctgaccgagacggtggacgagctggaactgcacaacgtcacggtcgtacgcggacgggcatccgaggtgatcggtcaggtggccgacgccgacgtggtgaccgcacgagcggtcgcggcgctggacgtgctggccggctggtgtctgccgctggcccgggtcgggggcacgctgttggcgctcaagggggcgtcggcggaggaggagatcggtgagcacggggcgcagatcgcccggttgggtggcggccggccggagatccggttctgtggcgccgggctgatcgagccgccggcaacggtggtggagatcgtgaaggaacgggaagtggcggccggccgaggccgtgatcgtgtcgtccgggcggctcgtcgtgaaggccgcggcggcggacgggggaacaagcggaggggttagatgggcaagcggggcgcgcggaagcggaaatctttaccggcaggtggtgcggctgccgatgaacacgctgtgaccctccctcccccgtcgggtcggggcccgctgggccgcggactcgctatgcggcttgtgtcgggtgtgatggagtttgtcagcccgaccggcgatgacgatgcggcgttgcgctcgactcatccggtgcgcggacatggcgacgtgcgccctccggccgtaggctggccaggcgtcgatagtgtggaccggatctcccccgccgagacacacgtttcgccggccgacccgttcctagccaacagggataaaacggtgcatgagtacggtgtttcacgtgaaaccgagtcgcctcttgaccggccgtcgcgagtgaacgctggtgatcagggcgttccgcagccgcgtcctagtggtaccacttatgggtacggtgtgcctgcgcccaggactgatgcgccgctccccgccgctccagccgccgtggcgcccgtttccggaacgccggttcagccggtggagcatgtttcacgtgaaacgccgggcggggatgaggacgatccgcccctggccatggaagcgttgcgagctgtgcagattctcaacccgagtggcgagatcatcatgccgcgcccggatcacccacgggttatctgtgtcgccaaccagaagggcggcgtcggaaagaccaccaccacggtgaacctggcggtggctctggcgctgcacgggaaccgggtgctggtggttgacctggacccgcagggcaacgcctccaccggcctgaacgtgccgcaccacgccggcgtcccggacgtctacgactgtctgatcgacaacgtgccgttggccgaggtggcccaagccgtcgagggtattccgaacctcttctgcgtgcccgcgacgatcgacctggccggtgcggagatcgagctggtgtcggtggtggctcgtgagtcacggctggcacgggcgatcgccagccacccggagaagttcgactacgtcttcatcgactgcccgccgtccctcggactgctgacggtcaacgcgctctgcgcggcccaggaagtgctgatcccgatccagtgcgaatactacgcgttggagggcctcaaccagctgatcaacaacatcaacctggtccggcagcacctgaacccgacgctggacgtctccacgattctgctgaccatgtacgaccggcggacccgtctagccgacgcggtggagcaggacgtgcggaatcacttcggtaccaaggtgctcaacgcggtcattccccggaacgtgcgagtctcggaggctcccagctacggccagtcggtgatgacctacgatccgggatcaaggggcgcgaccagctacttcgaggctgcgcttgagattgcggtgcgtggggtcaacacgggaggcgcggcatgaagaaccgtccgcggggaggtctgggccgcggcctgggcgcgctgatccccacggcgccggcggccgagccggaatctccggtcgcggtcgccgctgacggtttgccgtcgtcggctccttcggtagccccggtgtccattccggcgccgtcacccgcatccgctcccccggccgtcgcggtcctcgccgatgacgagttggcgccggtgcctggggcgcgattcgctgagctgccggtgtcctccattgagccgaacgccaagcagccgcggcacgtcttcgacgaagaggcgctggaggagctgaagatctcgatccaggaggtcggcttcctgcagccgatcgtggtgcgggagctgggcgacggccggtacgaactggtcatgggcgagcgccggtggcgggcggcccaggctgtgggtcgggagtcgattccggcgatcatccgggacaccccggacgatgtgatgctgcgtgatgctctcctggagaacattcaccgagcgaacctgaacccgctggaagaggcggcggcgtactcgcagctgcttgaggagttcggggtttcgcacgaggaacttgctcggcggatcggtcggagccggccgcagatctccaacaccatccggttgatgaacctgccggcgccggtgcagcggcgggtggcggccggagtgctctcggccgggcatgcccgggcattgctggggctggagggttctgaggctcaggaggagctcgccaagcggatcgttgcggaggggctttccgtccgggcgaccgaggagatcgtgaaactggccgagtcggaggggccggcccggaaggcggcgccggcgcggcgggcgaaggttcacgcgccggctctgaatgatctggcggagcggctgtccgatcggttcgatacccgggtgaaggtcgacatcggtcggaataagggcaagatcacgattgagttcgcgaccgtggatgaccttgaacggatagtaggcatgatcggtgtggaggaggagggggctcgatcctcgactccgtccggggtggacagcgacgagtaaggccttccggtgctccggtagcaaaggcgcgcgtcagagacgcgtgcctttctcattttccggttctgtcagcgccattctcctggggttttggatcggggcggaagcgcggcccggtgccttcgaaatgtcgctgtatgtggcattttcggctttccggcggacgttgtccatcgaccggtggacaaccggtctccacgactcggtcgtcccggtaggaggggcccagcgacgatgatttgttcatcgccgccgacgaggagcggcccaccgcaaggagagcccgatgcgactcgacgccggaatgaccgccatgatccgctcgatggctgcagacctcggactgccgttggtgggctactacgggctgcacgcgctcggtgctgacgacacgaccgccctcctcgccggcacggtggcggcggcggtccggatcgggtgggtggcgattcgcagccggtcgctcagccccttctccatcctgatggggtcggtgttcggcatcgggctggtgttcaccctcgtaaccggcgacccgcggttcatgctgatcaagcattccatcatgtcggcggtgatcgggatggtgttcctggcgaccgccctctgggggcggaagccgctgaccctatcggctcagcagagcttcatgccggccaaggcggcggaacttgcggagcaattcaaaaccagcgcggcggtacggcgtgggcatcgcaccgcttcgacggtgtggggggcgggtctgctcgtggaggcggcggttcgggcggtgctggttttcctgctgccggttgatgtgatggtcgggttgtccactgctctgacggtggtgacctttacggtgctgctggggtggaatgctcgctacatcgccgcgcacaggcgggctgcggcggcggtgctggtggcggcctgagcctgatcgggctgggcgggtgctggggctgggcggcgtggggcgtcgggcgtcggtcgtggggcctggggcgcggggcgtggggcgcgggggcgacagctcggcggtcgtttctggagcggtctggattctggtcggtggggattgagcggtttcacgtgaaacggtatggctggctgcgtagctgattacaggcccgtggccgatctccctaatccggcgttggacccgccaggcagcccgcgttcgtgagccaagtggtgtttcacgtgaaacagccctctagagctgatgcgggcgggattggccggtgagggacgagcagcgagccggtggtgcgaagtgccgccaatctggcgattagctcaatggacgcagagtccggccaatcgcgtgccatagtcccgacagattgccgttcccgcgctctgtcggctcccggcaagccagccgagcggccggtccacctctaggcgcccgccgaccgaggagccttgctcattgagcggcccgtcctgtccaccgaggcgcccgtccgccaagcggcctttgcaccgaggcgcccttccactgagtggcccttccaccgagtggcccttccaccgagtggccctttccaccgagcggcccggcgcgaccggctcgttggcggcccagcccccgagcggactgcccgggagccaacccgcccgcgcgacgaccgctgacaggccgtcttcacactgactggccattccggtagccgtctgatgggggcgacctccgtttcacgtgaaacctgacttattggaatgaggtcgtgaagggggcaaccggcgttcagagcagtggcggccgaagtccaagctcggcgcttagccgaccgaagatccgcattccgcgaagtctcgctcgggccgtccgattggcttgtcacggtcgtttgcctgcgggctcggtcgagatcggctcccgaacccttcgcccttcttcgtagaacgccgtcacgctctcgggagacgttgagggtcgctcagcccgccacgtctctctgggcgccgcttcagcgctgggtcctggtagtcaggcatcgcgtgcttctctaacgcaggtagccagattcgtggacgggggctgggcggcggagctgagcggcagggctgggcggcgcggctgggcggcgcggctgggcggcgcggctgggcggcagggctgagcggcggcactcggcggcggatcgtgggcattgggtagggcggcaggcccgggaggcggggccacggtggcgtgttccgggcgacaggcttcaagcggcagagtgctcgggtgttggggcggcgggtactggcccgcgagatgtcgggccacagggcaccgcgctacagagtgccgggcgccggggtgctgaacgtcgggtgctggacgacggagcgccgggccgcggggtgcgggacggccgggttgcgaacggcgtatgacgggtgtcggggcgatgggaagcggcgccgatggttgatggcgagtgccgagctctgtggcgagtttgctggtgagccttcggtcccggtgtgtccgcgggggcgctgatgtttggatgcggcttggcggtgttgattccggtgcgggatcgtgtgtgccgcgtgcatcggctggacgcgtgaagttagatgtcggccatgagaagttggatttagcagtcgtctgctgttagccggggcggttggctgtatagctgttaacgaccccctgctcctcgaagggtggaagtcgacgacgagggctggccggcccatgtctggtcgaaccggagctcggcatggcgtagcagaacggcgctggatggcgtggggacaaggcggcgctcgggtggcttgacgatcgaggcgggagccgagtttggacccgaccctgggcggcgctggggtgggttgccgatcgggttgggcgccgaatttgggccgaccctgggcggcgctggggtgggttgccgatcgggttgggcgccgaatttgggccgaccctgggcggcgctaaattgggccgggtcgggtcggacgcggggtcgggtcggacgcggggtcgggccggaccccggcgtcgcgggattgggccggacctgggcggcgctgaagtgggccgggtcgggtcggacgcgggatcgagccgggcccgggcggcgccaggttgggccggatcaagggcgggcgcggggttgggccggatctaggggagccggccggatagtgcctaagtagagccgagctgggccgggctggatcgactggatcgggtcgacaggctggaccggttgagctgagcggtttacccgagcggcataggtcggagcggtcagcaccgaacgacggatctacagcgtttacatgaagacgctacgtgttagccgcgatcagcgaagttgatacgcgacgccgtggtgatcacctcggcaagtgcggccttcgatatggcgttgcaaaaaagacttgttcaaggcgtagccgagacggcctcctggtatgggtgacagccactatccacaccctgtgggttttgctgctgaggtttgacggatctccgtttcacgtgaaacgacgccgatgggatgggggttgtccacggggctatccacagggggcgcaagcgttctacgtcgtgtttcacgtgaaacgcatgggcctgtggataacttctgtggataacttggggacatgtgtgtggagagacacgtgatcacctttgtcgacttgtgtggccgccggcgggacacaccggaggtgcgtcgtcctcgatccggcacagcgatgacgaccgctgtgccggcgggctgttgagcgcagggcgagccagaccagaagctatgtcggtcaacgcgaacagcgaacggcgccagctggtaaccgacgccagaggcggggagttgcggctggaccgaacccatctgccggcaacatcacccgcagaccgacccgcggcatggtcccgagacaccaactgaagtaccaccgagaggcgggactgatagggcccacggatggggcgtgacgagggtagggctaccgacggcacggaccgacgaataccggtagcgccatttttcgtgatcgctgttctcgctggccgagcgtcgaagtgaaccgtggcggagtgcaaaagcgccgacaacatgcgccggagggccgcccgcaccacggcgcgaacccgtctgcacgatcgtgcgaaattgggtcgggacaggccgtcctgggctgggctaaggtcacgacgtgtctgagaacaccggctcactgcctgacttcacccgctggccctccttcccgttcgagggtgacatgcgggtcaagaagctcgctcccccggtggaggtggagccgccgcgcagcggcgaggatggggccgactgtgtggcctgcactacgcccgatgacgcgtacatctgggtgtcggaacgatggcgggtgcgggccatggaccgacctaccgggctgccggccgtgctgatcctggagtgtcggtcgcacctcgacctgggggacctgccgaaccttctggcggccgagctcggcgtgatgacggtccggctggagcgcgcgatccgatcgctcgacggggtggcccgggtgcacgtgaaccgatggggtgacggatccgcgcacctgcacatgtggtttctcgcccggccctatggccggctgcaactgcgaggcacgttcctgtcgctgtgggacgacatcctgccggtcattccggagccgcagtggcgagaaaacctcgcgctcgtcgctgcctggctcgccgacttcggtggccaggccaacgccgcgccggccccgatcgaatgggagtcgccctcgacgctcaacgtcccgaccggcaccggtgacgggcgcgaggagacccgccggccggcgacgctcggcgacatgcaggccgctgcgactccggcgacggactcctgggtacgtcacaccgacgccccgtccgccggcagtccacccgcctcggcggctccgtcgcccgccgcagaggccggtatcccccaccagtccaccgtgcccgccccagggtcgaccggcgtgatcgcgtcgacggagaacgagcggatcccgttcggcaccggaattctcagcaccggggccggggccgccgcagccggcgcgggaaacaccgacggatagacccgtttcacgtgaaacgaacgggcgcgaccctccccgaggatcgcgcccgcttcaccagcacccgccgctaaagagccttccgatcaaccgcccgttccaccagaacccccaggatctctcccaggtccgccccatcagcctgaaccgccaacggcagcaacgacgtctccgtcatccccggcgaaacgttgcaccccaagacctgcgcttccccgtcctcccccacgatcacgtcgatccgggagaggtcccgcaaccccagggcctgatacgccgccagggccgtctcactcacccgggacgccaccgccgccgacagccgggccggcacatgccacgtcgtcagccccgccgtgtatcgggccgcgtagtcgtacaccccgtcccgcggcacgatctccacgatcggcagcgcccgtggccccgaccccaggtcgacgatcgacaccgccagccgggttccgctgacgtactgctcgaccagcgcggtcgagtcgtacgcgaaacagcccaccatggccgccggcaggtccgccgcgtcccggaccaccgcggcgcccaacccactgccgccctgcgccggtttcaccatcagcggcagaccgagccgggacacgatccggtcgaggaccgccaccgcccccagttcggagaaccggtcgtgcggcaacgccacccagtccggcgtcgggatgcccgactcccgcaagcgtgctttggcggacggcttgtcccaggcgaggcgggcggtgcgggcgtcggcccccacgtacggcaccgcgcacaggtcgagcaccccgcgcagcgacccgtcctcgccggtggccccgtgcagcgcgatcaccaccgcgtcgggcgggtcggcctgcagcgccgggagcagggacacgtcggcgtcgtgcagttcggcctcgatgccccgggacctgagcgcatccagcacccggcgcccggaccgcagcgagacgtcccgctcgtaggaaagcccgccggccagaaccaagactcgcaactccatggtggtgatcatgccaagtcggggccgggcgcgtcggcggcggccggaccgcgccggcgctgggacgacagggccgcggagccgccgaagaccgcgcgcatcgccaggtcctgctccatcaccccggacaggcgccgcacgccctcacgaagccgttccggtgccgagaacgagaagttgagtcgcatgttcccccgtccggtgccatcggcgtagaaacctgttccgggcacgtaggcgacccgcgccgcgatcgcccgcggcatcatcgccttggagtcgaggccgtcgggcagggtggcccagacgaacaggccgccggccggacgggtccaggcggtgccggccggcatcaggtcggtgagcgcgctcagcagcgcgtcccggcgctcgcggtagatctcccgatacaccttgatctgctcgcgccacggcatcgtcgtcaggtactgggtgaccgcgccctgggcgaacgcgctcgggcagagcacattcgcttcgctcatcatgaccagcttctcccgtacggcgtggggcgccaggatccacccgacgcgcagcccgggagcgaacgtcttggagaacgtgctgcagtagaagaccccgtcgcgccgtcgtgcccgcagcggccggggcgcgtcaccctcgaacgcgagcatcccgtacgggtcgtcctcgatcaccaggagcccggcccgctcgcagatgtcgagcacccgctcccgccgctgttcgctgagggtcacgccggccgggttctggaaggtggggatcgtgtagaggaacttggccggtcggccggcggccaccccggccgcgatggcctcctcgagtgcttccgggatcagcccgtcggcgtccatggccacgtgccgcacctgtgcctgggcggcctggaagacgccgagtgcgccgacgtaggtcggcccctcggcgagcaccacgtcgcccgggtcgaggaacagccgggccagcagatcgagcgcctgctgcccgccgacggtcaccaccacgtcgtcgggtgacgcgccctggatgccggagagcgccatcacctcgcagatccgctcgcggagctcgatcgtgccctggccgatcccgtactgcaggctggtggcgccgtggtcgacggccagccggctcatcatctcgccgaccgcgtcgagcggcagcgcggcgatgaacggcgacccgccggccagcgacaccacttcgggccggctggcgacggcgaacagcgcacggatctcggacgtcgtcatcccgcggacccgccgggcataacgatcggtgtagtcgtcctgggtagtaccggtcatgcggctctcacctcaatcactgaacgtgtgaacgaaactgtccatagattagtcgccacgggcaccatcgagagccgtccgtacgggtcgggcatcgccggacacgctcccgctcatgggtgcggcgacgtacgatttgcgaggcgcgaccgagcgcgccggtccggtgtccgagtcgagcgcagggggtccgcatgtcgcgacgcctggtcaatctcaccctcgacaccctggaggacctgccgcgaccgtgccgtcagtgcgtgtactgggagcttgatccggtctccgccgagcgggcctgtgcctccggtgaccccggcctggagaaggaggcgtgggtctcccagacgctgctggagtggggttcctgcggcaagctggcctacgtggacggcatgccggccgggttcgtgatgttcgccccgccggcctacgtgccccgctcgatggccttccccacctcgccggtcagtgccgacgccgcgctgctgaccacggccaaggtggtgcccgcgttcgccggcggcggcctgggccggatgctggtgcagggcgtcgcccgggacctgaccaagcgcggggtgaaggcgatcgaggcgttcggcgacgccaagccggacgaggacgccgagggcgcctgcgtggcgccggtcgacttcttcctgtcggtgggcttcaagacggtccggccgcacccgcgttacccgcggctgcggctcgaactgcgtaccgcgctgtcctggaagtcggacgtcgaatatgcgctggagaaactgctcggctcgatgagcccggagaaactgctccgcccgatgcccgccaccagttcgatcgagaactgatcaggtccggtcggccagcgccatccgcagcgcccgcacgtcgatcgacccggtcggcacgtcccgctcgaccgggaaatacatccgctgcaccgcggccaggatcgcctcgacgatctgctcccggaacatcgggttgaccagccgctcccgatccgccggcgaggtcaggtagccgaggtcgacacgcaccgccggcatccgggtcaggcgcagcaggtcccaggtcttggcgtgcgtgcggcagtcgtgcatcccggtgcggaccacgatttcgcgttgcaccagcgccgccagccgctcccccaccgtgctgctcagaccgctgccggtgccgtagtggtaggtcgccaccccctcggccgcctccgacggatgaccgtcgaggtgcagtgagatcagcaggtcggcgccgaggctgttggccagcgcggcccggtcggtgccactcatcggttcggccggctgcgggccgcgggtcaggtgcacccgcatgccggccgcggcgagccgaccctccagccgggcggccaggtcgaacaccaggtcggcctcggtccagcgaagcgggccgtcgggcaccagcacaccggtgtcggcgccgccgccgtgcccggggtcgatgacgatcgtcttgccgaccaggttcggtccggactggcggaacgcctccgcctcgcgcagccactgtgggcggccgccgaccaccttgcggccgaggcggcgcaacgccttcatggtctgcgggccgaccgaaccgtccggggccaggccgacctcgcgctggaactgggcgacggcgcgggcggtgcgggcaccgtagatggagtcggggcgacccgggtcgtaccccatctccagcagccgctcctgcaacgcatgcacgtcctcaccggtcagcgcgcccggcaccgagtggaacagggtgcgcgagccgagccgccagcgggccccgtccagggcgcgccacgtctcgtcaccgaccatgccgtccacgccgagaccgcggctctgctggaactcgcgcaccgcgttttccagcggctcgtcgaagacgtccggctcgggctcggcgagcaactccaggccgatcaggatcgaccggatctcggaaacggcagggccggtgtctccgcgtcggatggaccgcactcacgactccctaggggcgagaaagggacgaccttccggagcgtactccggcgggcaaaaagtgccccgcgtccaagcgcggacgcggggcaccgaaaagtgggaaagccggaagcggaggatcagagcgccgactcgatgaagttgaccaggaagctcttcggcttggcaccggtcaccaggttcacccgctcgccgtccttgaagatggccagcgtcggcaccgacatcacctggtaggcgagcgccgtctgcgggttctcgtcgatgttgaccttgacgatctccacctgcgaacccagctcggactcggcgatctcggccagcagcgggtcgaccttcttgcagggcacgcaccactcagcccagaaatccaccagcactggcttgtcggacgccagcacgtcggtggcgaacgacttgtcggtgacgaccttcacgaggaccctcccggtcttacagctcgacgaatgaagcgatgaagcgctcggcgtccagcgccgcggcacaaccggtgccggaggcggtgatggcctgccggtacgtgtggtcgaccaggtcacccgcggcgaacacgccggggatgttggtccgggtgctgggcgactgcaccttcacatagccctcgtcgtccagctcgacctggcccttgaacagctcgctgcgcgggtcgtggccgatcgcgacgaacacgccggtcacgtccagcaccttggtctcgttcgtctggacgttgcgcaggcggacaccgacgaccttgccgtccgcgcccaggatctcctcgaccaccgagttccactcgaccttgatcttctcgttgtcgagggcgcgcttctgcatgaccttgctggcccggaagctgtcccggcggtgcacgatggtcaccgtctcagcgaaccgggtgaggaaggtcgcctcctccatcgccgagtcaccgccgccgaccaccacgatgtgctggttgcggaagaagaagccgtcacaggtggcacacgcggacaccccgtggccgagcagttcctgctcccccggcacgccgatcgggcgccacgcggacccggtcgccaggatgacggcgcgggcgaagtactgctggtcgccgacccagacggtcttgaggccctcggtgccggcctcggtcggcttgtcggacagctctacccggctgacgtcgtcggtgatgaactcggcaccgaacttctccgcctgggcccgcatgttgtccatgagctcggggcccatgatcccgtcacggtgaccggggaaattctccacctcggtggtcgtcatcagcgcaccgccggactgcacgccctcgatcaccaggggcttgagctcggcacgggcggcgtagagcgccgccgtgtagccggacggccccgaaccgatgatgatcagattgcggacctcgtccactgccgactcctcaaggtttgtgtccacgccgatagaacgccatgctaggcattcaccattccccccggtcccgctcgtgtccgacctcacgccgggggtgccgttcagcgtaccgggaccgaaccgagcgtgtccgcgccgccaccgggcaatccgcagttgacgccactcgcccacgcccactggccgttggccgcgctgaaccgcaccaccagcgccgatttgccgttgaaccgggcataatccagcgattcggcggtcagccaaccgccaccgttctcccgggcgatcgcgtccaggcagtcctgcaacgcctgcggggcgcgcagccgggccagctcgcccagccaccggtcaccggcggccgggccgttcgccgcggcgtcggtcgaggccctgtccgagggaccggccgaggcgccgatcgcgccgccaccgggcaggccggaagcgaggcccgagtcgctgtgcggctccacgggctcgatcgcccgcttcggcagctgtcccagcgtggccagcgaatagtccagcccggaggtgagcacggccggcgccccctccggcgacatcgcatcagcggccccggcggccgccttcgatgccgcgctgtccgactcggaatgctgctgcccggccgtgtacccgaagaaggcgaccgcccccgccgcgacaccgatcggcgcggcgatccgcaaccaccgtttcgccccgcgccgccgccgctcatcaagatcaacaacagacttgtgtacgtcggtggccccgcccgcctcgccggagccttcgacgcgaggcgccccggagacaggtgtgggggaagaggccgtcgtggcatccgcttcgccggcgcggtccgtggtggtggagtccacggatgtgcggcgatccgcggtgatgcggtcggcgatggcggagtccgtggtggtgctgcgatccgcgacggtgccctcgacagtggcggactccgtggtggtgaagtccgcgggcgtggaatccgcggtggtggcgtgatcgaccggcgtggcgttcgccgaaccggtggtatcggtcaggttgaagccggtgccgacggtggcctccgcgagggccgcgtccaggcgggcgacgacgtccaccggcatcggctcggccggcaggccggtcagcagcgcgccgacggtggccatctccggggcgagcagctcatacgcctcctgccaggcggggtcggcggcgagcagcgcggcgacccggtcggcgtccggggtgccgtccagggcgccgccgacgaagtcggcgagcaggtcgatgtcgaccccgtggaagtccgccccggtcaccgctggtccctcccctcacgcccggccggctgcggcgtcgcgccgcccgacctggatgggacgccggcggcgccggtccggttcccatcgtgccccggctcactgtgagcctcccgcaagtcgcggagggcgagcgccatccgggcgcgcccgcgggcgcagcggctcttcacggtgccctcggcgatgcccagcatggcggctgcctcggccaccccgtaaccctgcacgtcgaccagcacgatcgcggcccgctgctcgaccggcagggcggccagcgcctcccggaccagcagcacggtgtcctggtcgggggtgggcgcgacgggttccggggcggaccggcggtcgtcgccggagtggtggtcgggcagcgggacggtcgggtgggcctggcggcggcggatccggtcgaggcaggcgttcaccacgatgcggtgcagccaggtggtgaccgccgagtcgccgcggaatccggcggccgcgcggtgcgccgacagcagcgcgtcctgcaccgcgtcggcggcctcctcccggtcgccggtggtgcgcagggcgaccgcccagagccggtcccggtgccggcggaccagctcggcgaacgcctcccgatcgccggccacgtgggcacggaccagctcggcgtcactcggcacgggatcgcccgcgccgaggccgccgggcggtacgtcccggagtgtcacgccagcaatctatgccatcgggccggcccccggcgttcccccacgtcacgttccggcatccgcccgccggaaacgctcacggcactcgtgagcgggagccgggaccgggcgcgagggaacgcgtgaggggcggctccccggcaggaaaccgcccctcactcagcgctgttcagcggctcagtacccgtacaactcaatctcgttgacgttgacctggtagcccggggtgtcctcgttgcgcggcagcttggtgaggaagaccagcacgtactgatatttcttgtccgggtcgaaaccgttcaggatcggctggtcgccggtgcttacgtcggtgctgtccgcgtcactgagcttcttgtacgtcttgacgatggtgtcgtcgccggcgctgttgtcgcccgggtccttgtcaccgacccgcaggtcgaggaccgcgccgggggcggagagcgagacccgcacctcggacagcgcccgcggctccttcaggtggatcagcacgcccatgccgggcttgcggccaccgaagttgggctgcaggtagtacgaaagcttccaggcggtgtccgggttgccgtcgaccacggcgtcggactcgccggagtccttccgctcgccctgcggcgggtcgacgatgcggaccatgtcggcggtcagcgggatcttcttcggctggcccagcggcgcgccgctggccgtgccggcgctgctgggctgggcgcccgcaccggcctggaccggcgacgacggcgacgcctcgggatggctcgacttgttgatcgcgcggatgccgaagaccaggccgacgatcgcgatgatcaccagcgcgccgaccccgaccaggatcttgcgggtgctccgggccggctcggtgggtgtgccaccgccctgcacgaagcgcagcggcccgacgtcctcgaagtcctcgtcctcggcggcggcgtcgagccggccgagctcggcggtgagcgcctcggccggcggggcggcgatccggccgtccagcaggtccatggtgaggtcgtcgaggtaggccgggacgccggcccgggcctgccgcggggcggccggcgcgccggagccgtcccgggtggcgtcgggcagcgcggaccggccgacctcggcgtgcggccagcgtccggtgagcgcgaagtagagcaggccgccgaccgcccggacgtcggcctccgagctgtccgcggcgtcggcgcgggcgtcggccagcacgacccggccgtcgtcgccgatcagtgtggtgcccgggtgcacattgccgtggatcatgccggtggcgtgcaccgcggcgagcgcgtcggagaccgagtgggcgatcgcgatcgcccgggccgggtcgagcgggccctcggaggcgatcagatcgcgcagcgactcgccgtcgacccactcgcgcaccacgtacgcccgctgttgctcgtcgatggcgtcgtagacgccgaccagattggggtggatcacccggctggccgcaaccgcggcctgcagcatctcggtggccgagtcgccgcccgggtgccggagcacgactgcgaccggccggcgcagcaccacgtcgatcccgcgccagacctgccggccggcgctgtcgttgttgacgtgctgctccagctgatagcgctcggccaggatctccccgacggcgggctcaccgaaggtcaagaccggtccggcctcgtcggccgcggtctcgtggccttcgccgacctgggtcaccagtcctccctaggtggtacatgactcggtgctcggggcaagggtgctcccgagcacatgccgacaacgaccatacccgcactcggccatggaccggcaggtcgtcccccggcgcggcattggcgcggccttgtacgaacgggtggttttccgggcagctcggtggaatcactgctgttccgggcggtgcgtggcggtgcggcggagaaaagggagtgggatcagcggccgagcttgcggcgcaccatgccgatcacctgaccgacctccggcacccgcagcagcgtcgcggcgatcacgaacgcgccgaggccgagcaccccctccacggccagcaccaccgcggtcagcgggaaactgtcatggaggtgcggggtgaccgtgtggtggatcaggaacaccacgagcagggtggccaggctggccagcccggccttggagatcacccggaacagcgccccgccgcccagccggccgagtcgccggcgcagcacgacgaccgagatcacgcagccgcaggcccacgccaccccctgcgcgccggcgatgcccagcacgacgtcggcggtcggcaggacccgggagagcaggaaggcggtgaggccgccgacgccggtcgagcccagcgcgatcatcgccggggtccgggtgtcgccgagcgcgtagaaaccgcgctgcagcagctgcaggaccgcgaacggggtgagcgccacggcgaacacccgcagcaccccggccaccatcgcggcgtcggccggcgacgacttgccgtgcgcgaagaccaccagacagatctcgccggccgcgccgaagagcacggccaccgccggcagcatcagggtgagcgacaggccgagcccctcgcgcagctcggtgaccagccggtcgaagcggccctcggcggcgctctgggtcatcttcggcaggatcgccgtgatgatcgagatggcgaccacggcgtacggcagctggaagaacatgtaggcgttggtccacggggtgaggccgacgccgtacctgatcccctccttgacgccctgcgcgccggccgcgttggccaggttggtgtagaccagcagcgcgacctgctgggccagcacgtagaccagggtccagctggccatcccccagatctgggtgagctcggcgcggcggaagtcgaagcgcagccgccagttgaagcccatccggtgcatcgccgggatcaggccgagggcctgcacggccacgccggcggtcaccccgatgccgaggtaggtcacctggccgtcggtgatgttgtccggggtgagcttgccgtgcgtcaccgccatgaaggcgcccagcacaccgatcaccacgacgttgttcagcaccggggtccacatcgcggcggcgaaccggccgcgggagttgagcgaggcgccggccacggcgctgaacccgtagaagaagatctgcggcaggaagaagagcaggaacatcgacgcgacccggtgctgggccggcgggaacctgctcgcgtacaggtcgatcagccacggggcggcgatcatcgcgcccgcggtgatcagcgcgagcaggcccagcaggatggtgaacagccgctgctcgaactcctcaccgtactcggcggaccggttgcgggcgcggatcagcagcggcacgtgcgccgcggtcagcacgccgccgagcaggatgtcgtacacgatgttgggcatcgtgttggcggtgttgaacgcgtccccgagggccgcgctgcccagcgccgcgaccagcagcgtggtgcgcaggaagccggtgacccgggaggccagcgtgccgatcgccatgatcgcgctggagcgcagcaggccaccaccacccgcctccggcgcctcgggcacctccggctcggcgaccgagccgtcggccggcatcgagctgtagcccgcggggctcggcgggacggcgtccgcggacgggggcaggcccgcggagtgggcgctgcggtagagaccgtcgtcgccccgggccgtgtcgctgccgcggtacaggccgccgttcactgatgcctccagagccgtaccgagattgttggaagccaccataagagaaaaggtcacacgtggtgctgctggagggtgcccggttcagctccggcgagggtctccaccacccagcatgcctccagcgggacaaggggctcactcagcgcgtcgaggatcgtcggatgatcacaaccggcctcggtcagcgccgccagcagatcgggcaccgcgtccaggtgcccggcgtgcaccatgcggcgggccagcgggctcacggcggcgtaccagggttgcaaggggaggtgggccaggtgtgtggtggcacggcggatcaggtccgtcagatcctcatgcgggaaccgtcggtccgcgcggacctggtcaccgatctcccccgggccgctcagggccgcgatggcggcctcgtccagcacctgcggtgacggcacgggcggcgccggccaccagcggtcgtcggtgaacagcggcagcggcgcctgctccggaccggacggcggcggcggtggcaccgcccggcgcagcgaccggtacgcggtctcgcgcatcgccgcgatcagcggcccctcgtccggcgcggcggccggggcgaacggtccgagcagcgcgaccaccagcccgggatgcggcaacgtcgggtcggccagcgcgatcacccgggcgcacacctccagctcgggccagcgcagcgcggccgggaacgggccgccgccgggcgccgagccgaggtggaccggatcgctggcggccggccggcgcaggccgagggcccgctcgtcgccgggcagctcgatctccaggacgaacgcgtaaccgtcgagcaccggcagcgacacccggaggaactcgggttcggtgagttcaccggtccagaacagcgggtcgaggctcagccggctcaacgcctcagaaacgggcacgggccccatcgtgcccggcggcactggcggtcaccaagcccgataccctggtaatcccatgtctgtgttgaacaatgcgtctgtgttgaacgaagcccagcagaacgcggtcgccgagttgctccgcgtctcacccgtcgccgacgagctggggcgccgcttcggcgccgccggccacgagttgcacctggtgggtggctcggtacgggacgcgctgctcggccgtctcggggatgacctcgacttctgcaccgacgcgcaccccgagcagaccctggccgtggtgaagagctgggccgacgcgatctgggagaccggccgcgagttcggcacgatcggcatccagaagaacggcctgcggatcgagatcaccacgttccgcgccgaggcgtacgacggggtcacccgcaacccggtggtgtcctacggcacctcgctgctcgacgatctctcccgccgtgacttcacgatcaacgcgatggccgtgtcggtgcccggccatgatttcaccgacccgttcggcgggctggccgacctggcgtcccgggtgatccggacgccggccgcgccggagcagtccttcggcgacgacccgctgcggatgctgcgggccgcccgcttcgcggccaaactgcagttcaccgtcgccgagccggtgatcgccgcgatgcgcgacatggcggccgacctggaccggatcaccgccgagcggatccgggacgagttcaccaagctgatgtgcggcaccgacccgatcgccggcctgcgtctgctggtcgacaccgggctggccgaccgcttcctgccggagatctccgggctgaagctggagatcgacgagcacgcccagcacaaggacgtctacgagcacacgctgatcgtggtgatgaacgcgatgcggctggagggcgacaccgcgcccgacttcgcgctgcggatggccgcgctgatgcacgacgtcggcaagccggccaccaaggcggtgggccgggacggccgggtcagcttccaccaccacgaggtggtcggcgcgcggctcaccaagcagcggatgaaggccctgaagtaccccaaggacgtcacctccgaggtggtcgggctggtcgccctgcacctgcggttctacgggtacggccggggcgagtggaccgattcggcggtgcgccgctacgtcaccgacgccggcccgctgctgtcccgcctgcacaagctgacccgatccgacgtgaccacccgcaaccggcgcaaggcggcccagctggccgccgactacgacgcgctggaggagcggatcgcccggatcgaggccgaggaggacctggccaaggtccgccccgacctggacggaaacgcgatcatggagctgctcggtgtgccgccgggcccgatcgtcggccaggcctggcgccacctgaaggagctccgcctggaccgggggccgctggatcgcgacgaggccgaggcggagctcttccgatgggcccgcgagcggggccacatctcctgacctactcgacgccgaaggcgacgtcgcggtcggcgaagtcgtcgggcagtcgcatgccggccagcttcttgccggtcaggtcgtaatagttcaggtccagcccctcggcggtcaggatccggtcgttgccgatgaatcggatctgatcgctgaccgccgggtagtcgaaccggaaaccggggatggtgccgaccacccggccggtcgccgtctcgatcacccgcaggccgtccggctggctggcgtcgggcagcacgacgacgtatcggccgtccgccgaccaggccgccgagccggccgggacgccgtggaccggcagcgtgcgcgacagctgaccggtcgacgccgagtagaccttgacgctcccgaccgtgtcgggccggtcctcggactgcgggacggccggatccacctgcccgatggcgacctccttctcccccggcagccaggtgtagaagcagtagtccgggcagccggtgtccgggatggtcacatcggtctcctggccggtcttcgcgtcgatggtccggatgccgccggcattgagcgacagcagcatccgctggccgtcggcggaccactgcatggcgccactgccagtgccgtggtgaagctgccggacgccgccggtctgcacgttcaggatgccgactccgccaacggtcccgtcgacccgcacgtatcgaccggtcggcgccgcgacgaactcctgatagtcgatggggtagacgcggtaacggccggtggcccggtccagcgccacgttcccctcgtgcaccgtccggcccgccgacgcggggatgctgtccaggctgttgaacgagccacgccggctcaccgaggtgatcaccacgccgccgggcaacgtgatcggcgccttccaccagtcggtgcggatcgccgcgaccggcggcggtgtgctgctcggtgtcacactcggcacgacggccggcggggccggctcggcgtgccgccggaagacggcgaacggcgtgatcgccaggccggccagcaccagcacggccgcgccgagcgcggtctgccggcggcggcggatccggcggccgcggatccgggcgaccatggcgaggtcgttcagcggtggcgctccggcggccaggtcggcgacggtgacgcgcaggtcacgatccaggttcctcatcgggtggcctccgtccagtcgtcgacgccgaacacgtcgcgcagcttggccagcgcgcgggacgcctgactggccaccgtcccgggccggcagccgagcacctcggccgtctcctcgacggtgcggtcctccaggtaacgcatcaccagcacggcgcgttgccggacgggcagtgaaagcagcgcggcgcgcagtgccaggcgcgaggtcacctcctgctcgtgccgtccggcctgcggccggtccggcacctcggcgacggtcacctcgttgcggttgccggcccggcgccaggtggagatccggtcgttgtagatgattctgcgtacgtacgcctcggcctccccgtgaatccgcggccaccgtgcgtatgccttggcgagcgcgccctgcaccaggtcctccgcggcctgccgatcccccgtcatggcgtgcgcgatccggagcagggcctgcccccgatccgccacgaacgcggtgaactcagcttcgagcgcttgtttcaccggtcacctcccccccgaatagacgccgacgcccgcgaaaaccttgcatgagtttcagatcacagccagtgaccaaccgggcagccgtccagcaacggagcaaatgccgtcgggtagccgggcaggaatagcaataattaccccttaatcggctcatattcgatgtgtctgaaaggttgatgcaatgccgttctgagcctccctaacctgcactcctgcccgcgtcacctgctatttcgcggcgcgggggaagaggggggtcgagcggcgtggcggaagaaacggtaagcaccgccgcgagactgctgagcaccgggcagaaggcgctcgccggtgcggccctggccgtgctgaccgccggcctggtcgtcgccccccgggtcaccgcggccgtgacggtcggcgcctgcgtgctgttctatctgctcttcgccctgttcaaggtgctggtcacgacagccgggcgcgggcaccggatgctgctcaccgaggtcctgtcctcgtcgacccgccagctgccgcactacggcgtgctgctgccggtgcaccgcgaggcgaacatgctgcgccgtctggtggcccgggtcagtcagctggactatccgcgcgaccggctgcacgtctatctgctgatcgagcacgacgacgagaagacgctggccgccgcggccgcgatcgggctgcgcgtgcacggcgacggcacggccgccgagggcccgctcggccacgttgtggtggtggtcgttccgccgggcggcccgaagaccaagccgaatgcgatgaacgtggcattccccattctggttgcggacggttgccgctacgtcaccatctatgacgccgaggaccggcccgatccggagcaattgcggctggccgtcgcgacattccgtctagcccgtcgtgacgttgtgtgtctgcaggccgaattggtcttctggaacgacgacacgaactgggtctccgctctgtactgggtcggttacaaagtgcatttccggcacttcctgcccggcctcgcccggctcggcctgcccgtgccactgggcggcacgtccaaccatttcaaggtcaacgcgctgctcgaggtggccctgccgggcggcctgatctgggatccgcacaacctgaccgaggacgccgacctgggcgcccgcctggccaccgccggataccgggtcgacctgatggcgtcggtgaccctggaggaggccccggtctccagtcgggtggtggacaagcagcagcgccgctggaagggcggctatctgcagaccgcgctggtgcacagccgccggccgtggcgcgcggcggcccggatgggcgtgcaccggtggctggcgttcctgctgatgacctacggcacgccgctcaccttcctgctcaacccgctgttcctggcgctggccggggtgtggttcgcgagcggctccgaggtgatcgtcgacctgttcccggcgccggtctactacaccgcgaccgggctgctggtggtcggcaacttcgggatcatgttggagctggtccagacgacgctggccgaggcgtcccgcaccagggggcgcttcgggctgctcaagtacatgttcatggcccaggtgatgtggctgtggatgagcttctcgacctacgtggcggtgttcgagatggtcaccggcaagcggggctggcacaagacgccgcacgggcatgccgagaccgacgacgacctggtgctcgtgctgcagggcgcgtcgtgagagcccgtacgcggatgatcgctctcgttctcggggcgacgcagctggcggcctgcgggcggctcgcgccgagcatccccgcggcgcctcccgtcaccacggcggcggcgccggcggcgtcggtctccccggcggtgcggactccggcgcagctgggtgtgcagatcttctggcacgacgtcaagccggagcagctgcgggagaacgccggccggctgctcgactacgtggccgggctcggcgcgaacagcgtcgggctgacctttccgatctacaccgacggcccgaagccgacccgtgtctacatcaaaccgggcaatacgccgactccggcggacatcgcggcgctgaccgcggcggcgcgcgagcgtggcctgcgggtcctggtccggccgctgttcgacgaggtcaacctgcgtcccgccaaggtgtggcgcggctccatcaaaccgtccgatcccgacaattggttcaagtcgtattcgaccgtgttggccccgtacctgaccgcggcacagaccgcacatgcggacggcttcgtcatgggatccgaactggactcgatgaccacccacccggcgcagtggcggaccgcgatggcggccgccggcaccctgttccgcggacggctgatgtacgccgacaactggggtgcctggatcgccggccggggcggggtgcccggagcggaccctggcgtcgacgcgtacccccgcttcgatcttccggacacggccagcgtcgcccagctcaccgacgcctggacgaactggctgcggacccggcgggacggccggctcggcgagaccgtgatccaggaggtcgggatcaccgccacgcccggcgcgtacgccaagtcgaacgcctggcccgagccgggccagaagctggtgccgcagatccaggcgaactggttcgccggcgcctgtgcggccgcccggtcgctggggatggccggaatctacttctggaccctgggcgaacccggccgacgccaccgggtacgacgccggctccttcatcggccgtggcgatcaggcgatcaaggagtgcttcgcgtccggatggccgggccggtgagcaccaccgagcggcacctgtcgctgacccaggagatccggatccgcaacgtgcagcggctgcggcgcgtcgaggaccgccggacccgccggcgcgccgacccggcgatgatcggcgtcgggctggccgcgaccgtgctggccgtcgccgcgtgcgtgtacttctaccgcgccgggcgaatcctgggataccacgacacgtactcgcacctggagatcagccggcgcctgctggtcgggcggaccaccggcatcgcccagctcggggcgatctggctgcccctgccccacctgctgcaggcgctgttcgcctggaacacctggctgtacaccaccgggctggccggctccatcgtgtcgatgaccgcgtacgtcgcctcatcggtgctgatctaccggatggtgcgggtgtacagccccgggcgggcggcaccggcggtcgccggcgcggccgtcttcatgctcggcgccaacgtgctgcaccaccagtcgacctcgatggacgagctgccgttctacgcgttcgcgctggccgcgacatacgggctgatgcgctgggcggacagccggcagccgacctacctgctgcacgcggcgatggccagcatgctggccatgctctgccggtacgagggatggttcctggccggggtgttcaccctcgcggtgccggtgatcgcccgccgtctcggccactcctggcccgatacccggggcctgaccggcatgttcgccgccttcgggctgttcacctcggccgccggttggatgctctacaactggatgatcgccggctcgccgctgaacttcctgaccggaccgaactccagcgccgaccagatgtcgcgacgcaccaccgacgtggagaccggggatctgggcaggaccctgcacgcgtacgcgggggcgctggtcgccgaccacggattcgtcgtgttgggcctcgcggtggccggactcgtcgccttcctgctcggcgaacggctgtcggcgcgatcgctgccggtcttcgcgctcggctcggtgatgccgttcttcctctacacgatctatcgcgggcaggccccgatcggcatgccgccggtcaacgaatacgtgctcaacgcgcggttcggcttgatcgcggcgctgccggcggcggtgctggccggatatctgatcgcccggctgccggggcggacggcgctggcggcgtcgatcctggtgatcgcggcgctcggtgggctgaccacggtcaccttccggcaggacgcgctggtcagcgtgcgggaggtgaccgacgacctgtcgtcgcaacaggaccaggtgcgggtggccgccttcctggctgggcacaccagcgggccgatcatgctggacctggtcgggaacgagcgggcggcgttcccggtgctggaccgggtcatctacgacggtacgaaggtggggcggcgcaatgtctggcgggaggcgctgacgtcgccgcggtcggtgggtgccgaggtcgtgctgatgcgcggatccggggcgcggggccgggacgccgtctacaacgcgctgcacgacgcctcggcgatgcagggataccgggcggtctacgaagcggacggatacaccgtctaccagttgtcgtgacctcgaatctgtcgtaccggcgaggcagactgggggcatgttcgtcgtcgagtcaccgatcgggccgctcggcgtcgccgtcgagggcgatgtcgtggtcggggtgcgcttcggcgcggcgcccgggccggccgccgagcatccggctgcggcccagctgaccgcctatttcgcgggcgagtcgaccgccttcaccgtgccggtgcggatgcgcggcggatccgatttcgagcgcgccgtctggaccgagatcgcgaaaatcccctacggcgaaatgatgacgtacggcgcgatcgccaccgccctgggcgaccccggtgcggcgcgcgcggtgggcacggcctgcaaccacaacccggtgccggtgatcgtgccgtgccatcgggtggtcggcgccggcggcaggatggtcggcttcgggggcgggctggagcgaaaacgccggctgctggagctggaggcgcgggtggcgctgacgcgcgcctggagctgagggagcggggtggtggcttgctgacgacgtacaggcaagcaaatgttttgatcttgcctcggataacctgctcgggtgcatagatccgttgcgggggccctgacggtggcgatgatggtggtggccgtcgccggatgcgacggcgccaagggcaagccaccggcggcggtgcagcaggatccggcacagctgatcgccgagctgaccagggggatctccccgtcgaacccgtatcgggatccgaaggcggacgagcgcaccacgatccgccaggcggcccgggcgatcgccgatcaggacgcgaacggcaaccgggacaggctgttcagcgatctcggcttcgtcgtgcaccgcgggacggacccggcgaccggccgcgccttcgacatgtacatcgcgaccggcaccgacaagcgcacctggggcgcggtgctgatcgacaccaccaggaaacccggcatcgtgctggaggtgccgcacaccggcttcgacctcaacaccgagaagctggggctggccctgcaccgcgaggtggacagcagcgtgctgctggtggccggggcgcaccggcaggcggccggcggcctgggcgacgtggcccacaacgacaagtcgctgttccacctgttcgccaccgagctggcgggcaaggggctggagcagttgcagctgcacggctacgccgacaagaacctgcccgactccgaggccgtggtgtcgaccggaaaggcccgagtcggcccgctggcgcgcgaggtggccgacgctctggccgacgccggcgtcgacatctgccgggcctggaaacgcaggtgcggtgaactggagggcaagaccaacgcgcagggcagggtggcctcgctggagggcgaccagttcgtgcacgtggagatgagctactcgatccggcgcgacccgggctcctgggaccggctggttccggacctggccgcccggatcaacgaaggctgacccgggcggccgggcgtcagatgcgccgggcggtgcgccagagttcggcccagtgaccggtgccgtccaggatggactcgccgcccgcgtcgcccatggtcgggccgttcgccttggtgcggctggagatgaagcggtagtgcccgcggtcgtcgacacccaggaacatcccggagtgctcgatgtgcgtgcccttgatcggaccggcgttgaagaacaccatgtcaccggggagcagccggtccaggttcaccgcccgcttgccggtgttcggcatcagcagcgtgcccggcccgaccgcggccagcccggcggcctgacgcggcagacccggaccggggttgttggtgccgcgcagcgggtagccgagccggtaaccgtagaccatccgcaggaagccggagcagtccaggctgcggatgtggctcgccgacggcttctccttcttgtccgggaaggtccacgggacgcccaggtagtcgtagaagtcggagttctccgcgcgcccgtccgggtcgatgtcggacagcgggccgaacgccgcgtccccggagtactgccggccggtggcgtccttcttcggcttcgcggtgtacgtgtactcgaaggcgagcgccagcacgtccggtgaccggtcggtgcgcgccttggtgaaccagtcgacgaaccacttctcggtctcggcgcccttgtgccagggtttcggggcgagccgcacccagtactcggtgaccagcttggccttggtgaaccgggcctcggcgaaggtgcgctccggcccgttcaggtgcacggtccgcgaggtgtcggtcatggtcgccatgaccttgccggtggcgtcgaggaattcggtgcgggccggatccacgccccgccgcacccggtagccgagtccggccgcgaccgagccctggtcctcggagccgagactgatctcgaccgcctcgggcatcgtcgagcgggccgccgcgtacgcgacggagccacccccgaccagcaccagcaggatggccagcgtgaccagggtggcctggctgcgcgtataggtctggtaattcatctcgttcccgtcaggtcgtcggcacgagaccggccacgatgccgctgaacgcgacgccgtaggtcatggcggtgaccaggccggtggccagcagtgtcgccttgggcggctgccggaccagctgataggtgatcaggcccggggcgacgaagcccagggtctggtgggcgaacagcagtggcaggtcctgctggaccagcacgaagagggtgagctgcaggaagacgctgagcagcacgatcgccgcgaacagccgcttgccgtagaggatcaccatgcgctgcaggaccttggtgagcgtgtaggtgaccacggtcatcccgacgatcaccgcggcgtgcatcttgtcctcgatcagggccagcgcgatccacccgggggtgatcattccgcccggggagaggttggtggtcaggtagcagagcagcgcgaagaccagaccgatgccgaggcaggcggtggaaagctgggcactgagttctcccccgaaggtcaccggtgggtcctttccagaaaaactgtctcggcgagcacgtcgaagccgggcgtggtggagacccgcagcatcgagtcggagcggccgctgccctgcggctcccagctgggcagcgccgccagctcgtgcagcagcacctcgccctggccgtggatgttgccgaccgcgacgatcgacgcgtcggggccgaccaccgccatcagctcggcgagcatccggtcgccgggcatcttgcccagatcggtcacccggtcctgcaggccggccgggacggcgaccttggcgctgcgggtcatctcaccgatcagcacgatgtgctgcggttgcacccgctcggccagggcgcccatctgcccgttgcgctccacccggtcgggccggcagttgatcaccatggtcagtggccgggagatcaggccctgcttctccagttgcgcgatgttcatgaacgtcgactcggggtcgttggccgcgaagatgttggcgaaccgaacccgcttgtcccggtacagcacccgggccaccgacagcacgcccgggtccggcggtgcggcccacatgccggccagcgcgctctgccggtcgacgccgagctgcgcggcgacggccagcgcgatcgccacgttctccttgaaggtgatccagccgaaaccggccatctcccggtccgtcaccgactccgggtcgaccgcgatcagccggcacttccgcttgtccgcctcctcctgcaggatcgccaggcggtccttctcggcggtgatgcagacgccgccctcgggcatcgagcggctcagtgagcgggccacgtcgtccagggtcgggcccatctcggccaggtggtcctcgcgcacgttgcagagcaccccgatgttcgactggatcagcttgctctgattgatctcctgcagtgccggcatgaccgccatgcactcgatcaccagcgcgtccgggtggtacacggcggcccgccggacgatgccgatctgctccaccacgttggcgatgccgaacttgcggtgcaccggctcctcgctggcgtccgggaagatgaagcgggccgcggtcccggtcgtcttggccaccaccaccttgttgccgccgcgcagcgcgccggcgcagagccgggtgatcgagctcttgccgcggatgccgttgaccagcacccggctcggcatcagcttgaggttgcggtagtggttgcgttgctcgatcacgccggccgccagcagcgccaggcagcagaccgagaagacagcgtagagatacagcacgatcagcccttcgacgagcggctgtgggaccggacggcgcggtcggcgagggacaggacggtggtgcggtccgggccttcgccgcgcaaccggagcgcgccgccgaagcgggccgagccggtgtgccgcacctgacggcagatctccaggcagatggcgaccgcgccgatgtcgtcgtggcgctgcggcggcaccgggtggtccaggtcgccgctgctcatcttgtcggcgaagaatgccaggcggcgcagcggcaccacgaagatgtagaactgccacatgtgggtgaccagcacgatgcccaccaccacggcggcgaccagcagcagccagcggtgctcgaccatctccggcagccgcacgccggacacgtcctgctcgaccaccacggcccactccaggtgggcgacgctggccggttccaccatgccgaccgcggcggccagctccgggtgaccgtcagcggcggcgccccggccgacggtcacgccgggcagcgcctccaccgcgacctcccgggccagccggccggtcagcggctggtaggccacgtaaccccgggagtcgagcagcgtccgcagctccgagtcgaccacccggacccggcccttgacccggccgatctgtccgagcagacggtccgggtcgaactcgccgatcaccgcgtacccgctgggcagctcgttgtaggcgtagaccaccggcagccggccgatcgcgtcgtcgaggtggatgcccacctcgccggggaccggcaccggggtgcgcagcggctgccggccggtcttgctgagcacctcgcccttctcgtccaccaggtacagcgcgcgcagccggtcgtcgtcggcgagggcgcgctgcaacgtgtggccggtcgccgccaggtcgtcggtcttcaccagccgggaggtgcgggagacggtggccaggccgtcgtcgaggaagtggcccagggtgaacccggcgctctcggcccgggtctcgccgtcccgcaccagctgcgccggcagttgcgggtccggggaccgccagaccatcgccaccgcggcggccggccagagcagggcgatcaccgcggccagcgccagcccctgggtcaccgacggccgccaccggcggccctccgggaactcggcgccgacggtggtggcgagcgccttggcgatccggtgcgcctcccggacaccgagcggccggcgttccctggtggtggccccgctggcgtcctccttggcctggttgagcagctcgcggaccgggcggaccagcgacttgcgcatgatcaggaagctgagcagggccacggcgagcaggctcgccccgatcaggaggcccttggtcaccgtggtgcccttggcgaccggggcggtcagcagggagaccacgaccagcccggtgcgacccaccggggccgccgcggcgatcagccgggtgtccggccactcgtcgacgatcacctcgcggaccttggacgaggtgatcccgtacaggccgtcgaacaccttcgcctggtgcgccacgtcgatcgcgtgggcgccctgcagcaggctgctcttgccgtccccggtgagcaggtggatgccgtgcttggcgtccgggttgaggcgcagcgtgcgcatgaagatcggctggacggccagcagcgactgcgttccgtccagagccgcgctgtagaccagcatgggcccgtcggcggtggtcaccgcgaccggatggccggacggcagcgggttgggcagtgcgtccaacggcacggcgtcacccttggcgacgaccgacttacgcgttgtcatgtccacaatggcggcgccggtcacccggttgccgtcggcgatcgcgcgcaccagcagatcggcctgcgagaggctgccacggctctgcaggatccggtccagcaccgtggtctcctggtggatctccgcctcgaagccgttggccagcttgatcgcgatgtcccgctgcgagtcggcgatcgccggcagggcgccggtgtgcgcgttgacggtgagccccagcaccgcggccaccaccacgaagaagctggcccagaggtacgccagagacggcgcgctggtgccggccgggaaggcggccgccggcagttgctgagtgagcgcgcggcgccgccaggccagcagctcttcctgctcctgagcgagctccgccgcccgggacgtaacggtttgagccgaccggcttgacacgaatccctaccatccccgctgacctggcgctcgccctgacgagccgccagatgctagcaaccttcggctttcccggggctcaggaggatttaccggttccgtggacgatcagccctgcggcactggccccatgggtcaggagattaccgtcgatgcgatcgacggccgcctcgtagatcttccgctgcggggccgaaagatcgggtttcgccagttcgcgcggcaggtcgacgagccggatgttcggattgaggtccacaaaggtgggaatcgcctccagagccatcaccttccaccggcccggaaccgaggatgggccgaatgtgaccttcatcatcgctccgtctcgattggagttgatcggctcggcatgccgggcgatctggttgcccatgccatagatgatccaggtatttccgatcttctcgaccggctgtacgacgtgggcatggtgaccgaagacgatgtccacgtccttgatctgggcgatggcccgggcccaggtctgctggtccacgtcgggctcgtgctcgtactcggtgccccagtgcatgctgacgatcacgatctgtgcaccggccttgcgcgccgccgcggcgtccttacggatcttcgtgacgttgatctggttggccacccatgccttgccggccggcggcttcaacccgttgaagtccttggtgtagctcagatgcgcgatcttcacgcccttggccgtgtagatcttcggcttcgccgcgtcggccgcggtccggtagctgccggtgtgccccaggcccgccgcgtccagcgcgtccagggtccgctgcacgccctcgaaaccctggtcgatgctgtggttcgacgcggtggagcagccgtcgtacccgaggctcttgatgccctgcacgacctcccgggggacgctgaacttcgggaagccgatgtacggcccgccgggtggcgccaccgcggtctccatgtggcacagggccaggtcggccccggagaccgtctccttggccgaggccatcatcggcgcgaagtccatcgtcccgttgccgtcccggcgagcctggtcccacagttccggatgggccaggatgtcccccgcggcgagcaccgacaccgtacggccgggcaccgacaccggcgggtccagcgggcgggcggcgctggccaggtccggagtgtcggctgaccagggtccgaacgcgtagagcgcaccggccgagaccgccaccgcggtcaggcaactgaggaccgctttgagcggagaagtcgactgggggttactcgccaccgcgacaggttagatggatcatgccgggaacagaaaaagccggcccagggacgggccggcttccgctgtcgggtcggagagcgggtcagcgctcggtctcgcccttgatgaacgcctcgacggcgttgtgcgcgtcgtggtcgctgtactgcaccggcggggacttcatgaagtacgacgaggccgacaggatcgggccaccgatgccgcggtccttggcgatcttcgcggcgcgaaccgcgtcgatgatcacaccggccgagttcggcgagtcccacacctcgagcttgagctcggcgttcagcggggtgtcgccgaacgagcggccctcgagccggatgtacgcccacttgcggtcgtcgagccacggcacgtggtccgacgggccgatgtgcacgtcgctcttgatcatctcgtgcgggatctgggaggtgaccgactgggtcttcgagatcttcttcgagaccaggcggttgcgctccagcatgttcatgaagtccatgttgccgccgaagttcagctggtacgtgcgcagcagctcgacgccgcggtcctcgaacagcttcgccagcgcgcggtgcacgatggtggcgccgacctggctcttgatgtcgtcaccgacgatcggcacaccggcgtcggcgaacttctgcgcccactccgggtcggaggcgatgaagaccggcagcgcgttcacgaacgccacaccggcgtcgatcgcggcctgcgcgtagaacttgtcggcctgctcggagcccaccgggaggtaggagaccagcacgtcgacctcggcgtccctgagcacctggacgacgtcgaccggctcggcctccgactcctcgatgatctcgcggtagtacgtgcccagaccgtcgaaggtcgggccgcgctgcacggtgacgccggtcggcggcacgtcggtcagcttgatggtgttgttctcgctggcgacgatcgcctcgctcaggtccatgccgaccttcttggcgtccacatcgaacgccgcgacgaacttcacgtcggagacgtgatagtcgccgaaggtcacgtgcatgagacccgggacgcggtcgttggggtcggcgttcttgtagtactccacgccctgcacgagggacgaggcgcagttacccacaccgacgatggcgacgcggacggagcccatcgcgtttgcctccttgttgttcatcacggccggtccaggtgcggacgcggtggttccgagggggattccgcagccgggtgggcggcggagtcggggtaagcgccggccaggccggcgcgttggcggaatgccggggtgcggccggagcgctcgttggtgatcagctcctccagccagcggacctcgcgctcacacgcgtccagtccgtgccgctgcagctcgagcgtgtacgcgtcgaggcggtcggcggcgcgggcgagaatctcccgcagcccctcccggcgctcctcgacacgcctccgccggccctccaggatccgcaaccgggtagcccggtcggtgcgggagaagaaggcgaagtgcaccccgaagccggcgtcgtcgtacgtctccggtccggcggtggccagcagctcggagaagcgctccttgccgtccgccgtgatcttgtagacaacccggccccgtttgctggtcatcgggggaacaatttcgttgttgttcgccacggcttcgctgatccagccggccagcttcaaccgcttcagcgtcgggtacagcgtcccgtagctgatcgcggcgcgcagcgtgccgagtttggtggccagctccttgcggagctcgtaaccgtgcatcggggcttcctgcagaagcccgaggatcgccaactccagcacctcgaccctcctccagtgtgtgccccgatgtatcggcccgatacatcgtcaccgtagatcgggatccggtgaggcgcaactcggccatccctgcgctgtcgccacgccacgctcagtgatgacggtcgccgtgcgagcggggaccgcgtactctcttcgccatgcgcacgcagcgacaggtggtggactactcgcttcagaggcgagctgtcctgcgtgacgtgcgcaatggccggatcagtcccctcgaggtctgcgacgcctcgccgtacctgaagaacgctgcgacgttccacggcgagccgaccgatgagcggtgtccgatctgccgccgggagaacctgacgctggtgcactacgtctatggcgacgagctcaagcagtcggccggccaggcgcacaaagccgccgagttgccggtccttgcgatgacgctgcgtgagtgccaggtgttcgtggtggaggtctgccgctcctgctcgtggaaccacctgatcgagcgctacgtcctgggtagggacgcgctcgatgcggacgagccgcccatgcagtggaaaacaggttcggtgtcacacgtcggggagggccggcggtgaaccggatcgatgccagtaacgtggacatgttcaggaccgactcgggcagccagcgccgcaatcggtcatttcagacgaacgcccgctcgtggcacggtcgcccgggagatttcccggacagcccggccgcgcccccgcgaacggtaggtgtgaaggaatgaatccgtacggcgaaccgcagaatccgcgtgcccgggcccgagtgcccgggccttccgctgcttccggaccggacgagcaggaccgccccgccccggacgcgtaccggcggtccgccggttccgcggcggtcggtggccgcgcctcggtgggagccgcctccgtcggtgccgcttcggtcggcgccgcgtcggtgggttcggccgcggtcggtggccgcgcgtcggtcgggtcggcctcggtgggtgccgcctccgtcggctcggcggcggtcggtggccgcgcgtcggtcggatccgcctcgatcggcgggcgtgcctcggtgcccccgccgccgcccccgggtggcggcggctcaggcgggtcgggtggcggtgacggcggcggcggcaagcgtccgcgcaccaaggccgacaagaagtaccgccgggcgaacatcctgaccgccgcggccgcggtgctggtcatcatgatcggcgcgggcatcgtcggcggcacgtacttcttcgacgacgtcgagctgccggtccccaagcccgaagcgcagatgaacctcatctacaacgccacgggcggtctcctggcgcaggagggtgacccccgggtcaacgtgccgtaccaggacatcagcgacaacatggcgcacgccgtcgccgccgctgaggacaagaacttctacacccacaacggcatcgacctgaagggcatcgcccgcgccgcctggaacaacttcaccggcggcgacaagcagggcgcgtccaccatcacccagcagtacgcgcggcacgtcgccgacctcaaggcgatcagctacagccgcaagctgcgcgaggcggtgatcgcccgcaagctggagtcgaagtacaacaaggcccagatcatggggctgtacctgaactacatcgacctcggtgagggccggctcggcgcggaggccgcggcccggggctacttcaacgccaccatcaagaagggtggcgacggcaagctcaaggagatcaccccgtaccaggccgcggtgatcgcctcgatcatcaagcagccgtacccgaactccgtgcacaagggttacgacccgctggtcaacgagcccgcctcgcgggaccggtgggaatacaccatgaagaacatgctggacatgcactggatcaaccagcagcagtacgaccagcggcaatacccgaaggcccaggcgaagaccccggcctgcaagacctgtgccgacggcaagccggtcggcatgatcatgcgacacgtcacctacgagctgcaccagctcggcatcaccgacgacatcatccgcaagggcggcctgtcgatcaccacgacgatcgacccggacatccaggccgcggccgaggcggccggctcccgcaacagcgcgacctcgccgttgcacacccggcccagcacctaccagtccgcggtgatcggcatcgacccgaccgacggtgaggtgctcggctactacgccggtgacgatcccgagggcatcgactacggcggctacatggccggtgacggcagtggcgtgatggagagtggtgggcagtcccccgcctcgtccttcaagatctacacactgtccgcggcgctgaaggcgaactactcgttcaacacgctctgggacggcaacaaggagcgcgtcggcggcggcaagatcagcaacgccggccaggacggcggcaagacctgtaacgacaacggccacagcgtctccagctgtgacctggagcaggccaccgtcaagtcgtacaacttcccgttctactggatcgccgaccagctgcacccggacaaggtcgtcgcggccgccaaggcggccggcatccactacatctggaacaacgacggcaagcgcatcgacctcgaccacaccgacgcctcgacctgggacaagtacttcagcgacgagatcggcttcggtcagttccgggtgctcccgctggaccacgccagtggtgtcgcgaccatcgtcgcccagggcgtccggcaccagacgcacttcatcaaggcgatcaagtcggtcgacccgaccagcggcaagcagaccaacctgaagaccattcccaaggacggcacccgggtcttcgacgcggcccagatgtccgacctgaccgcggtgctcaagaggatcccggggcacgccaaccacaccctcgccggtggccgcgaggcggtcggcaagtcgggttcctgggagctcaaccagaaggagagcaccaagaacggcgacgcctggttcgtcggcggcatcccgcagctggctgccacggtctgggtcggcggcaagaagaaccgggttccgctggtcaacggcaacggcggcaagatgttcggcgccaacgagccggccgcgatctggaagaagttcatcgacgccgtcgccgagaagaagaattgggaaaagaaggacttcccgccgcggcagcccggtggcgacgacagcctgggcaacggcaagcccctgccggtgcagcagccgacgcaggacaacagccaggtctgtggtgcgctgtcgttcctctgcggtggcaacaacaacggtggcggtaacaacaacggcggtggcaacaacaacggtggtggcaacaacggcggtggcaacaacaacggtggtggcaacaacggcggtggcaacaccggcggcggccccggcaccggccccggcggcaccggcaccgggacgacgaacaacgacgggacgacgaccaacaacggcggttgatgtcctgaccgactgacgacggcgcccacctcatcgaggtgggcgccgtcttctgttccggtccactcggtgcgccgcgtccgggtgaggtccgatctccgggcttcatgcggcatgatgccaagacatgagcgcgcaaccgtccaccgaccggcccgacgtcccgagcgcgacctcggacggtttcgtgcggggactgtcgcagatcatcggcgggccgctgggctcgcatgcgacccgcccggacgcccggccccaccgattctggaccgccccgcggttcgtcctggccctcacctgcctgatcctggcgctgtcctgggtgcagaagtcgccctgcatgagcggcgactggcagaagaacatgcagtacacccggttctgctacaccgacgtgctggccctgtactacgccgaagggctcagcgacggccaggtgccctacgtcggccatgaggtggagtacccggtcgtcaccggctacttcatgggcgcgatcgggctgccggtgcactggtacgggacgacgcagaacacgaagatcaatcagggcagctggttctacaacatcaacgcgctgatcctgtcgatcctggcggtcgccaccgcggcggtcctgctcgccctccgccggcgacgaccatgggatgcggcgatcttcgcgctctcccccatcctgctggtcaccgcaacggtcaactgggacttcctggccatcgggtttgccgccgtcgggctgtacctgtgggtgcgccggcagccggcctgggccggcatcctcctcgggctgggcgcggcggccaaactgtggccgctgttcctgctcgggccgctgctggtgctggcgatgcgcagcggacggatccgggcgttcgtggaagcggcgctcggaacggtcgccgcgtgggcggtggtcaacttcccggtctggtactggcatcacgaggcctggctcaagttcttccggctcaactcggaacgcccggtggactggggcacactctggtacgtcgggcgatacctggacggcaagtggaagagcggggcggccggcgaccagggcccgttccagtggctcagcgaccacgtccccaccctgaactgggtgacctacgcgctgttcgggctggcctgcctcgcgctcgtggcggtcgggctgctcgccccgaagccgccgcggctggcccagatggcgttcctggtcgtcgcgttcttcctgctgaccagcaaggtgtggtcgcagcagtacgtgctctggctgctgccgctggtggtgttggcccggcccaagtggggggcgatcctggcctggacggtggccgagatcgggtacttcgccgccttctacgccgagctgatcggtgccggcggcaagccggtcatccccgagggcacgttcgtgctggcctccgcgctgcgcctgatcaccgtggcggtcctgtgcggcctggtgatccgtgagatctggcggcccgagctggacgtcgtccggcagacctacggcggggcggatccggacgccggcgagctggacgggccggacgcgccgtggatcgagcggatgcggctcggcttcggcttgatcaagccgaccgggccggtcgagctggtgcccccggacgacccggtcgtcatgaaggcctagcaatcctcatggagcggggcgcaccgtcaggtgcgccccgttcttttcgtcctgcggcgcccgctctctcgttgtgtggcgcccgctctctcgttgtgtggcgcccgctctctcgttgtgtggcgcccactctcgctccggcggaatccggtcgttcggttctgcggcgcgccggtccggctctgccggggccggtcagtccaggtggaagaccacggcgtcgggcaggtcctcgcggcggatgccgagcgagtcgaccggcagatcgccggcctgctcccatggcgtgccggcgacctcggaacggatcagcagcaccgtgctgatcttgttcgaccgcagatattcgatgctggtcagatcggggaacgaggcgacctttccacgcatctccgcctggcggaccgccgcgacccggccgccgccgttggccacctgctgatagcgcgaggtggtccagagctgcacggtctgatcggtgacctcggccgtcggcagcaccagcagggggccacccacggtccgcatcgcggccggctgggccggggccaccgggtgcgcggtcgcgttccagccctcgaggatcacgagcagcaacggtacgagggtggccaggcgcaaccaggggctcggccacggcggggtccgctgcgcggcgaagtggtcgattcgccggacgaactcgtcgaccgccccggccgccaggatcgccagcaccagcgtcacccagatcatcagccggccgggcaccagcaggtcgaacgaggccggcaaatgcccgaacagcggaaggtacgtccagcggccggcgaagaatgtcgtgcccagcgtcaggatcatcgccacggccagtccgaggatcaggaacagccgctgccgccaccgccagatcgagaagatcagcccggccagtgccagcgcgtacagcatgaacccgggaagcagcgacatctccgccgccgcaccgagcgaaccgcgcggggtggcgtgcgccgtcccccagatccgcgactcggcgggcccgatcagcaggctgcgcaccggcggcgagagcagcccgatctgcttccaccgctccggcacgtccggcacccgcagatacgggatggcgaggaccacacccatcccggcgaacagcagtacgccgaggaagtcggccagcagaagccgccatccgagcaccgcgtggctgggccgggcattctccttccgatgccgcgccccccgccgcctgcgccgcccgcccgctccagcccgcctaccgcgacgcttaccgacgtccttcgtcccggctccggcgtccttcccggccccggcgtccttcgtcccggcttcagcgttcttgccggcttcagcgttcttgccggcttcagcgtctttgccgtcctcagccgtcttcctcgcgccgcccgcctcagccccggtgtctttcttgccctccgcgcccgcctccgcggcattccccgcctcagcgcctgttgccgcgcctgcggccttctccgccccggcaggctgcttcgcctccggggccttctccgtctcggcaggattctctacgcccggggccttccccgactcaccggcggtcgtcgagccagcggccttctcaccgacagagcctttgccggcgtcatcggtcctgccggcgtcatcggccttggcatccgagccggccttgtcaccgccatcggccttgatctcatcggcggacgcgaccttgaccctgccgcccgctgccgtgtcctcggcccccggctgctccctgtcgaccgcatccgccttgacgccggttttcgcgagtgtcacaccctcgctggcaaccgcgcccttcttgtcatccgcggcgaaacccggagctgccggaacctccccgccctcaaccggatcttctcccgtttcggacttctcgtcggccgcgggcatgtcggtggccttggcgggtcccttcgcggtcgcgggattctcgccgcccgcggcctcggagccaggcagggcatgttcgccgccagcggagtccttaacgccggcagggtcctcaacgccggcagagtctttggcacccgcagagtctttggaacctgcggagtccttggcaccggcagagtgtttggtaccggcggagtccttggcaccggcagagtctttggtacctgcggagtcctgggcacctgaaggatccttgccgtccgcagcggtcttgctgactgcggcctccgcaccggacacggcgggtttgccggtgtcgacgccgctctcccccgccgccgtcgcggtggctgccgcgagcgccgccgccttcttccggcggcgccgctgcaccagccgtcggatcggcaccgccaccagcatgaacagcaccacagccgccagcacgaaggcgaacggcaaccccaacgagaagccgagactgagctgccagaccgccaccagccagcccagcgccgcccacccggcgtgccgtttccccggccggaacccgtaccggatcgaccatccgtgcccccgggccagcagcgccagcgccagcgggatggcccccgccgacacgatgtcgaggtgcccttcctgggcaaggcgccacggcgcgtacgcgaaggcggccgcccccaccgccgccccggtcggccgggcgccgagctgccgcaccagcgcgtacgccccgaacagcagcagtgcgtgggccagcacgaagaggatgttgtagcgcagcaccgccgactcgggcccggcgccgagcagcccggccggcgcatagcccagcaggctgtcgccgtaggcgaagctgtccccggtcgggaagtacgcgttggactgccagatcttgacgggattggtccgcagcacgtgccccagccaggcgacctgccacgcctgccgggacgggtcgccgaggtcgtgcggcagggtgtgcagcggatatcgcagggtgggccaggtcagcccgaccgccagcagcgagcaggcgtagatcgccagccggtattcgtggatgaaccaccgcccggtcgcccgcagtccgcggcggatccggccgggcggtttctccgggatggcagcgaatgcgcgccacgggtcctggggcactccgggtgggcgcgtctcgggcagctccttacgcttgcgcgtcccctgtggagtcgcggcggcactcttcgcggccgtcccgtccgcttcctgcgtaccgccgctgtgcttgtggtccgtcgagtccgcggacccggcgcgtttttcgtcggtcttgccgtccccgtcttttccggcgatctcggccccggcttcatcggcgacatcggctgaagaagcacgcttttcggtttgtccggacgccggcccgtccggagccggtgcatcggccgatttcggatcggaggcctcggcggccgccggcaccgctgcgccgacggctttcccgtcccccgccgcatcgacatccttgatcgcctcggcgccacccgaagtggccggctccgacgcgatcgggagcggggccggagccggtttcccctccggtgccgaagccggttgtgcaggtggcgacggagtcacgcccttttcgtcggcgcgcttggacccgaagatcccgaaaagtcgcttcctcctcggcttccccgaccccggcgtttccgcgccgtcgtcagcggatgtggtcgagagcggttgcggctgctcggtcatgaccctccccggacccaggtatctcaggagcccgaccgctcccgcagtagggcgatgtcggcgctctgcccggccaccccgcccggagtctccacaatggccgtggccccggaggcgcggatggcggcgaccaccaactcggggtcgatcttcccactccccaggttgtcgtgccggtcctggcccgagtcgaaaccacccttggaatcgttggcgtggatcaggtcgatccgcccggtgatcgccttgacccggtcgacgatgccggtcaggtcctccccgccggcgaacgcgtggcacgtgtccaggcagaaaccggccccgaacgagccgaccgcgtcccacagccgggccaggtcgtcgaaccgtcgggcgcacgcgttgtcgccgcccgcggtgttctcgatcaggatcgggagggggaggccgccgtccttctccgcgtactcgaaggctttgcgccagttgtcgaagccgacggtgagatcgccgccctcgacgtggccgccgtgcacgatcaaccctttcgccccgatctcggcggccgcgcgggcatgcgtcatcagcagcttgcggctcgggatgcggatccggttgttgggcgaggcgacgttcagccggtagggcgcgtggatgtagatgtccacctcggaagcgcggagctgctcgacgtcggcacggggtgccgggttcttgtagctctgcgggtcggacaggaagaactgcaccgcctcggcgccgcgggcggcggcctcggccagcgggtcggcggaatcgacatgggctccgatgcgcatgggacgagcctacgacgcgggtccgacactttccggcgagcgtcaccgggctccgccacgcgtcgttagccccatcgatcacgtttgaccgattccggtcccggccggtgacgtactggggagatggtcgatgtcgcggcagttccgataccggatggcggcgctggtggccagcggtctgatcttcggcgtgccgctgctcaccaatggcacggcgaacgccgaccagctcgaacccggggcgcgccgggtcacctttgacggtggcatgctgggcctgtcctgcggctcgaagccgagcgtggagagactccgggtgccggccgagagcaccctgcacgtggtcaaccggaccgggcacaacgcccggctggagctggccggcgcgccgcgtggcgtgatcccggagaacggcgccgccgaggtggtgttccgccgcggcaccacgccggtggtcctcgacccggactgcgccggctcggacgacccggtgccgatgctggtcaccgcggtgccctcgaccccctcggcgctgcctgacccggcgcccggcggctcgaacgccggcacgctgccggcgatcgtcgcgggctcggcggggcagtcggtggccggctcggcccttccggacgacgacgccaccgggtcccggcccccgcatcaggtagccggcccgcgcggggtccgcgatccggaccggcgccggaccgccaaggtgcacgccgccggcgaaacgccgcggcaggataccgatcagaaggtcaaaaacgatggatcgcgtacgtcggtagcgggcggaccgacattcgcgggcatgccgccgggggagcgcaagaccgtacttccggcggaccgcgccgcggtggtgaccgcctccccggccggtaccgcccccgccgcggagtctcccgcggcagccgagccgcccatcctcaccgagccggcggcggaaccggtggccgcgatccggccgatgcggaccacccatccgatcggtctgctcggactcaccgcgatcgtctgcgtgctgggggtactgaccgccgcgattcgggcaatcgtgtcgcaacgtgcatctcggtcaaatctggcgtaagattcttgtcgtaaggctccgcggggcgaccgcgtccacctcatcggtgtggtcgttcctccccaggtcccacccaacgaaccggaccggacgccccgcggctctgcgtcacgaagaccccgtccacccggacggggtcttcgttttgggctgtgcacccgacctgggtatgctggctcggttcgcagactgttcgccgtggggcgtgatggttcccacggctttcttctgcgtgcggcacaagacctcctgccacggaaagaccgtggccgtatagcccacaggaggtgaatgtcttgcgtcattacgaactcatggtgatcctcgacccttcgctcgaggaacgcaccgtggccccgtcgctcgaccagtacctgaacgtgatcaggaccgcgggtggctcggtggagaagctcgacgtctggggccgtcgccggctctcgttcgagatcaacaagaaggccgaaggcatctacgcggtcgtcgacctgcaggcgacgcccgaggccgtggccgagctggaccgtcagctccggctcaacgagtccatcctgcggaccaaggtcatccgtcccgagacccgctgaggcgtttttgtcagagggtcctgagaccctttgcgtcaacgacttgagcggcgaggagaagtttcatggctggagaaaccgtaatcaccgttgttggcaaccttgtcaacgaccctgagctgcgcttcacccaatccggggcggcggtctgctcgttccgcatcgcctccactccgcggaccttggaccggcagtcgggcgactggaaagacggcgagccactcttcctctcgtgcagcgtctggcgtgacgcggccgagcacgtctccgagtcgctgcagcgcggcgcccgggtgatcgtgcagggccggctgcgtcagcggtcgtacgacaccaaagagggagagaagcgcaccgtcatcgagctcgaggtcgacgagatcggtccgtccctgcgctacgccacggcgaaggtgcagaaggcgagcaggtccggcggcggcgggggtggcttcggcgcctccggcggcggtggcggcggcaaccggcagttcagcggtggcaacaacagcgggggcggcggtggtcggggcaacagcaacgactacgacgacccgtgggccacggcagcaccggcctccagcggcggccgctccggcggcggcaactcctcgttcgacgacgagcctcctttctaagccccaccaggcttccactgccggcggtccgccgccggcaaggatcaccacttcaggagttctgagcaatggctaaggctgctgcgcttcgcaagccgaagaagaaggtgaacccgctcgacaaggacgggatcacctacatcgactacaaggacaccgcgctgctgcgcaagttcatctccgaccgcggcaagatccgtgcccgccgcgtcaccggggtgacctctcagcagcagcggcagatcgcccgcgcggtcaagaacgcccgcgagatggcgctcctgccgtacacggcgacggcgcgctgaggaggatcacccaaatgaagatcatcctcacgcaggaggtgtcgggcctcggcacccccggcgacatcgtcgaggtgaagaacggctacggccgtaactacctgctgccgcagggcttcgccatccagtggaccaagggcgccgagaagcaggtcgcggtcatcaagcgggcccgcgaggcgcgcgagatccgtgacctgggccaggccaacgaggtcaagggccagctggccggcctcaaggtcacgctgagcgcgcggaccggcaacggcggccgcctgttcggctcgatcaccccggccgagatcgtggacgccgtcaagaccgccggtggcccgtcgctggaccgccgtcgtctcgagctcccgggtcacatcaagaccacgggctcgtacaacgtccaggtcaagctgcaccccgaggtgaccgccacgttcccggtgaacgtggtcgccgccaagtaagtccttccgcaccaccacaacggcatgccggcccgcccggcatgccgttcgtgtttctccacccctttcgtatcgccacgctccgcctctccgccctgccgccgcggtcttgcgggggtcgctccgcttgttctcgcgtcgcgctcgctggtgccggcccgcgcctcctgcttcacccgcgcccatccgcgctgattgccctgccggcccgtaccccggcgcccgccccgcgtccgcccggtccggcgctcgcggccttgtgtcggtctggtcttgtgtcggtctggcctcgtgccggtctggccttgtgtcggtctggcctcgtgtcggtctggtcttgtgtcggtctggcctcgtgtcggtctggtcttgtgtcggcctggtcttgtgtcggcccggcctcgtgccggcccggccttgcgcctgcgaccatgtgggcactcggcccccgacgcctgcctgaccttgcggcccgcgctggccggcccggcccgcggcctcgcgccggcccagcctcgcgccggcccagcctcgcgcttgtctggcctcgcgcctgtctggccttaagcgcgaccggactcgcgcgccagtctgcgccgaggtggtgcgagaagtcggtctgcgccaaagtcgggcgccggcgaggtgtgcgtcgaggcggtgcccctgaggcgggtgtattccagagagggtgcaccagggccggtctgcgccgcggcgggtgcgccgagccggcctgtgtcgagctgggtgcgccggagcggtgtgagccgaggtggctcagtggggcccgcggcggagccggtgaggtggggtcagctgaggctgttgccggtgatggcggagctgaggacggtggccaggccgccgccgactaccgcggcggccaggccgacgctggcggatttccatgagctggtggcgaagcggagaccgaaggccacgatgatgctcaacgtgagcgagatgccgaattccggggcggcgttggccagggtttgcagggcgtgggcacgctggccgctgttgagcaggagcattccggcgatgaacaggacgaccgggacgccgtaccagacgacggtgtagccgaccgcggccagcgggctgctggaggtttccggctcgtcctcgtcgtccgggttgagcaggtcgttctggcggctggagagcacgccgctgctgaccggacggcgctcgtaggagccggtgttctcgaacagtgcaccgctgacctggcggcgcggcggccaggaggtgtcctcttcgacggctgcggtgccggcttggcggcgtggcggccaggaggtgtcctcttcgacggctgcggtgccgggctggcggcgtggcggccaggaggtgtcctcttcgacggccgcggtgccggcttggcggcgcggcggccaggaagtgtcttcctcggcggccgcggtgccgggctggcggcgtggcggccacggggtgtccgcggtgaggggagcctccgcggggctggccggggggacggcgatcaccgaggtggcgctcagcgccaggttggcggcgccctcgacggcggcggaaccgctcggccggaagggcgggaagtcggaggtgctgaaacgctgcggatcgccgtcggcgggggcggactcgcgggccatctcccggcgccagtcgtcggccgcgggagccggggtgccgggtgggcggtagccggtggcgccggagaccggggcggtcgcgcccacggtcggagcggcgcccatgtcggcgcgccaatcggtgccggccgcggcggaggcccggtatccggcggcgctggacgtgggggcggccgtcgagccgttcatctgggcgcgccagtcggcgaccggagccgagccggcacccggaacactcgacgtgggggcggcgccgttgagctcggcgcgccagtcgccggccggtcccgggacggaggcggcgggtggcgttgcggcggcacggtagccggccgtcccggagaccggagcggcggtgagcgaggttccccctgcggggccggtggttacggcggcgccaccatcatggccggcgccgccgttgaggtccgcgcgccagtcaccgcccggaccggcggggcgataacccccgccgccagtgtcggggccggtgcggtaaccgggggttccgggggagacgtcccggcgatagccgccggatccgtcccaggacgaaggttcggagccgttccaggcggacgggcgccgatcgttctggccacggccgccggtgccgccgtacggcgggtcgtcacggtcgtcgcggcgacgcggatcggcgtaccgtccgggttcgtcctggtagtcatcggtgccgggccagggggtcggaccgctgggaagttcgcgctgcgcgccgtaggcgggtttgcgcggatcccgcggctcgccggacggcgcccggtcccgggtcggctcgccgtaaccgttcgaccgccaggaggtgtcgtcgtcccgccgctccggggccgcgggcagctctcgcatgccgtaggacggctcgaccggcaccgcccgcgccccgctcacccggcgggtgtcggaccagccgtcgccgtcgggcgcaccaccgcggcgcgagccacgcctagctagctagcccgctcggctcgtcgtcccactgtccgcgccggccgccccagcccaccgcaccgtccggcgtgggctgctcgccccggcccggctgctcatcggcgtcgccctgccgcatctggtcccggcgggccgcctcggcgcgccaggccagcacgcgcggatcgtcctcggcccggctccactgcccggtgtccgggtcgcgggtccagttgctggtgtccggttcggcgtcccaggacgcggtgtcctcgcgccagttcgtcgggttggcgttgtaccgctgcgggccgcgcccacggcggctctgaccccgctggcgttcgggctgacccgcggaggcggcgccggtgtcgatcgggccgctcgggccctcgtcgggcgcggcgcggcgtgacccgggtcgtacgccgaactgaatgggggtctgcccacgctgcgcagcagcggcgtcgtccggcggcggaggctgcgggccgcggcgcaccgaccggctgccgaaggagggtgccgaggtcggcgcgtacgagatgttgccggtgtcggcgtggccggcccagttgtccgtctcgtcgccgctggaccagccggagccgccggagggctgctcgtcgggctcgggcgcgcgacgacggccgcgccgggtggaccactcggtgtcggcctgccgccacgccgcccggtcgtcctcgcggacgtagtgccggccgtcgtcgcgcggaccgctctgccagccggagccgccggaacggtcccagccggcgacgtcggtcgtgttctccccgggggtgcggcggccgctgtcccacgaggtggcgggctgctgccaggacggggtcccggagctgctccaggtctgctcgaccggtttggtcgcggaccagctcgacgacacgtcccgggtgttgtcctcgggggttggccaggcggtgccggaaatggtcggctgctgctgttcgtcgtcgtcgccgggctgccaggcctcggtggtggagcgccagacgtgtgagccggtcgacgagcgccactcggtggtctgccgccagcgcgccccggtggcccgccactccgaggtctgggtgcgccagccggtgccgtcggcggggaaggtgggccggccggtggcggccacgtcggaccaccggttggccggctcgacggcctggccgccaccgcccgaatacggctcgatctcgctctgctgcgcccaggcgtcggcgcggcgctgccaggtgagcgcctccgggctgggcgtcatgctgccggtgtcggtgagggcggaccagcgcggctcggcgtcgtcgatctccgcttcccgttcacgggtgagccaagggtccgcagcacgcctctcgcgtgacatgcgggcaccgtagtcccactcccgttggtccacctgaaaagggtgacgtgccggaggcggaatcgcaacgcctcacagcgacggcctgctcacccgaccaagtatttctgcagatccatcagcttttctgccctccacaggaagcggctggaaaagtgctgctgaggctctttccccaagagttgtccacatgctgtgcacaggcctgcccacaggttccgggccccctgtccacaacttgtccacgactcgtccaccgcggcagttgggcaggtggcggccaggttcgtagagtgggcgagcccgctgatcgaccgcttctgctgaagtcgtgacgggaccggccgaaaggtcgggtgagggcggtccgatcgtgatggcggcatggtcagtttggggggatgtcccggtgtcgatcaccgatgacgcacgaccggatccgcggccaccatctcagccgtccgggggaccccagagtggcggatccggccggtccgacgcgccgaccggcggttcgttcgataaggcgcccccgcaggacgtcgccgccgagcagggcgtgctgggcggcatgttgctgtccaaggacgccatcgccgacgtcgtggagatcctcaagaccggcgatttctaccgcccgatccacgccaccgtcttcgacgtcatcctcgatctgtacgggcgcggtgagccggccgacgcgctgaccgtcgcggccgccctggccgacagcggtgacctgcagcgcgttggtggcgtaccctatctgcacaccctgatcgagagcgtgccgaccgcggcgaacgcctcctactacgcccggatcgtcgccgaccgggcgatcctgcgtcgcctggtcgaggccggcaccaagatcgtccagttgggctacggcgccggcggcaacggcggccgcgacgtcgacgacatcgtcgaccgcgcccagcaggcgatctacgacgtcaccgagaaacgggtcagcgaggatttcgcggcgctcggcgacatgctgcagccgactctggacgagatcgaggcggtcggtgcctccggcggcgtcatgcagggtgtcccgaccggcttccaggatctggatcgcctgctcaacggtctgcacccgggccagctgatcatcgtggccggccgtcccggtctcggtaagtcgaccgcgagcatggacttcgcgcgcaatgcggcgatccggcacgggtgcgccagcgccatcttctcgctggaaatgagcaagatcgagatggtgatgcggctgctctccgcggaggcgcgggtgccgctgcacacgctgcggtccggccagctctccgacgacgactggaccaaactggcccgctgcatgggtgagatcagcgaggccccgatcttcgtcgacgacacgccgaacatgaacctcatggagatccgcgcgaaggcccgccgcctcaagcagcggcacaacctgaagctgctggtcatcgactatctccagctgatgtcctcgccgaagaagacggagagccgccagcaggaggtctctgagctgtcccgtggcctcaagcttctggccaaggaggtggagtgcccggtgatcggcgtcagccagctgaaccgtggccccgagcagcgcaccgacaagcgcccgcagctgtccgacctgcgtgagtccggctcgatcgagcaggacgcggacgtggtgatcctgctgcaccgcgacgactactacgacaaggagtcgccgcgcgccggcgaggccgatttcatcgtcgccaagcaccgtaacggtcccaccgacacgatcacggtcgcggcgcagctgcacctgtcccggttcgtcgacatggcgatctaggcgaggtccgccgctggtcccggcccgctgcccggcgcggcgcggcgccggctccgtcaactgcttgcggcgtacgtcgatagcccaccctgccgtgaccaggctccgcgccgtgggccgagcccgcctgcctgcccgctgccgatggccgtggcgtggcatggcgtgtggtcggtgcggctgctccgggagggttggtgatgcccggcacgccgggtcgcggtcggtgccgcggcccccgtccggcgtgcgacgggcatcgggatgagccgtcgtgtccggcggctcgcggtggggtcaggcggtctcgtccggcgggcggtgcgtggtgaccagctgttcgacctggcggtgcttgccggcggacgcgtgctgcaccgtctcgacgatcacccgggccagcgtctccacattccactcgcggcaggcctgctggtcgagacgcaggtcgacgaggtcgccgtcggcgttcacggtggcgcgcacgaggccgtccggggatgtggcgctcacctgcatcgtggccaggctgcgctgtagttcgtccactccggagcgtaattcttcgtagcggccgtagacgtttgcaagatcgttccgcagcgcctggtcagccgcacgatcagtggtttcagtcacggttcttcctccgttcgccgcgacagggggcgacgtgacaatacccaagatccgcgacgttgcgtattccagcgacttcgtaacgcgaacgtaaagagagccttatcgaaatagctcgctttaaagtgacgggatgactccggtttgtggtcaccgagcgtgacgaatgccactgtggctggtcgaggtgctcatcagcgtcgaccctgcgctgatcagtagtcgcaggtgacggcgcgagaaccggtggcatcgggacgggccgcccgcggcgccgcgccgttgcactccgtcagtgccgcacggctcgttggtctcagtgacatctcgcgcccgtccccattcgcgggcagacgagtcccgcgcggcccggccggaaactgtcgaatgggctggtgagtggcctgtcggccgatccgtgccgattcgggtgacacgtcggcgccacggcccgtacggccgattcgatgatcagggcagtgaacggtgagcgggggtggcccgaggggctggccccgggcggccaggtccggatggcacgaggggcccgcgccgaacccgggccgtcggtggtcacgactcggcgaagcccggatggcccgaggggcccgcgtcgaacccgggccgtcggtggtcacgaacttcggcgaagtccggatggcacgaggggcccgctccggatggagcgagcccctcgtggaggatcagcaaatgagctagccgtcagacggaacggatcccggcgccggcgaccgcgcccgtcagtcgaacagatcgtgcaggaagctgcgccggtggtggtagtgaccgtggtagccgtgatgccggtaatgaccgtgatgtccgtagtgcaccaccggctggtggatcaccggcggcgggtagtgcgcggctggagcgtggtgcaccggggcgccgtaacccggcggcggcgggggcgggggcggcggcgggtagccgtgaccgccctagctagctagcggcggcgtgtgggccgccggcccgggcgcctgcgccggacggttgttgtaggttgcctcggccgcgaagagcttctccagctcgccccggtcgaggaagatgccgcggcactccgtgcactggtcgatcgtgacgccgctgcgctcgtagacccgcatctcgccgtggcacttgggacaggtcatctgcattccattgacggtacaaggccatgtcatgccatggggcggaaggacctgtgcgtctcctgaacgggatcggcggcggcgaccccggcgtcggcggtggcgccgggatcggcggcggtggtggcggcggtggcgccgggatgggcggtggtggcggtggtggcgccgggatcggcggtggtggagccgggatgagcggtggtggcggtggtggcgccggggtcggcggtggtggagccgggatgagcggtggtggcggtggcggcgccgggatcggcggtggtggcgccggcattggccgtggcggctccgcgatcggccgtcgcatcgccgggccgcagggtatgtgcccacaccaggaacgccgccggatacagcaggtagccgaaccgggtcgtcggcatcagcaggatggccgcgagcaacccccacccgcagtatgccgcggccgcccccgcatcccggggcggccgccgcaggagcagccatccgatcaccagcaccgccccgcccaacagcccggccgccagcacgtgaccggccggcagatgctgcgccaccagatatccggggaacggcgactgcgccgggctggtcaccagcccatgccccagcgggaaccgcagcacgttctccaccagcgaatccgcgttcaccagcagcggcggcaccagggccagcagtggcagcccgaccgccccgggcagcagccggcggccgcgaccgctgaccagggccagcacggcgagaaccgccaccaccgggaaggcgaacagcttggcgccggccgccgcgcccacggcgattccggcccacccgaaccggtcggtggcggccagtgccagggcgagcaggcagagggcgagcaccggaatgtcgtcgccgccggtcgccagggtcagcgccgtcaccgggagcacggtggccgcctgcaacccgcgtaccgggaaagggtgtgcggcgcggaggaccgcgacggccgagccgaccgcgaggatcgcggtgatcgcgaaccagacccgcgcatccgtccaccaatggtcaccggcgatggcccgcggaagcccgaagaccgccatgcctggctggtacggccggtagcccagcagccgctcgtcgaccggcagcgcggcgatgccggcccggctcagatacggcgtgccgtggtcgagcagtgacctgcccatcgcctcgacgaccagcacctcgtcctgggcccggtcggtgcgcccgccggcccgctgcaccgcctccaccaccaggggcacgagggcgacagcggcccaggtgagccacgcctgccaggtgcggaaccgatcggacaccggccggccggtgagaagttgcccggcgaccatcagggtggcggccaggtagccccagaaggcggtcaggccccatccgcgatgcggcgacagtgtcgaggtcagcccggtgaccagcgcgaacgccgcagagatcagatagaggccgaggtcggccgtgagtccgtcggcgcgtttggtcacgccggcaagtgtggcagagatgatccggcgacccggcgggccggcatccggaccaccgcaccgacctcgtgcaacgccgtggcgagcacgccgggccggccgccggaaccgcgccgcagggtactcaggaagcgggccgaggagagcggccgggcgaacaggtggccctgcccggcgaggcagccgagctcccacagcgcccgccgctgcggctcgctctcgacaccctcggcgaccaccgtgagctgcaggttgcgggccaggtcgacggtggtccggatgaccgcggcggcctcggcggaggtctccaccgcggccacgaacccgcggtcgatcttgagttggtgcaccgggatccgggagagcacggagagcgacgacaccccggtcccgaagtcgtcgacggccagccgcacgccggcgtcgcgcagctcggcgagggtccgctcgaccacgtcgatctggctgagcgtgagcgtctcggtcaactccagcaccagctgcccgggcggcacgtcgtggcgttccagccgggccagcacggtggccgggaagtgcgggtcgagcaggctgcgcggcgacacgttgaccgccaccggcaggtcgaatccggccgcccgccacgcctgcatggccagcagcgattcctccagcaccgcgtcggcgaaggccggcagctgcccggagcgttcgaccgcctcgaggaaccggccaggggagaggtcgccctggtcggggtgccgccagcgggccagcgcctcggccgagaccacctcgccgctgccgaggtcgacgatcggctggaagtccacagtgaactcgtgctcgctgaccgcgcggcgcaactcgccggtcagcatcagccgctcgacgtccgcggtgtcccgcgcgtgtgcgtagatcgtggtcggctcaccggcgcgtttcgcctggtacatggcgatgtcggcgcggcgcatcagctcctcgacgccgcccgcgccggcggccagtgcgatcccaccggccgcctcgacggtgatcatcatgccctcgacctcgatgcccggctcgagtgcgcccagcatggcggccgcccggtggctggccagcgcgggcgtgggcagggcggtgagcagcaccgcgaactcgtcgccgccgagccgggccaccaggtcgccgggctcggccgcgccgctgagccggcgggccacctcgcgcagcacgtcgtcgccggccgcgtgcccgagtgtgtcgttgacctctttgaagtggttcaggtcgatcagcaggagcgcggccaggccgtcgtgaccgccgtcggcgaacaggtggccggcctgctcgtagagctggcgccggttgggcaggccggtgagcggatcgtgggtcgcggcgtgcgcgttctccgcggcgatccgggcgagttcggcgtacgcctgcgcgttgcggatcgcggtgcagacggccgacgcgaaggtacgcagtttgtactgctccacctcggtgagccggaccgtgccgccgaaacgcaggcgcagcacaccgacgcgcagcccaccgtcgtgggcgaccagatccacagtggtctcgtcgggcagcgtcgggccggccgtccgggggctgtcggtgagcacgtgcgccccggtcgcgcgtaccgtccgatcggctcctccggccgtcaggtcgatggcggcctcggccgccgagaagatctgcgccgcgcgggtcgtcgcggaatgcagcacctgggtcaggtcgaccgcgttcagctcgtcggtggccttggccaggcgttgccaggactcgcgctcctgccgggtgcgggtggtgcgcgactgccagaggtgcatgcaagccacaacgagcgggacgaccagcagaagcatgacgttcgcgtcggtggccagcacccagagcacgagcaggcaggcgacgaactggccgaggtggctgatcaccttgccgagcagattctgccgggcggcctgcaggatgccgatgtgcgagttggtggccacgatcggggcgaagaccaggtcgtcgacgaacgcgtaggccagcaggccggcggtgatggcgagaatcggcagggccggggcggtcaggtcgggccggatccccagcgccagaaaggcggccgccgccgcgctcaccgcgagcgtctccttggcgaccgcgaacgcggtcttgcgcaggccggcccgcaccgcgatccgcaggatggcgtgcccggcggcggcgcagagcagcagccacaccggggggatcagggtcaggccgacgaggaccggaacctcgtcccaggcggtgccgaagaagttggaccggatccggacgaagacccgcagcttgttggtggtcaccacggcggccagcaggagcgccaggacgaagagcggggggcggggctgcggggcgtggtacgcgtacaccgcccagatggcgccgacgccggcagccagcatgacgacgagaccgacgagcagctggagccgctgatcggtcgcgtcgtcgttggtgccagtctcagacatggtgtccccgtcgctctgtcctgccggctgggtcctgattgccgaccgcgactgagtggtagctcagggttcaaggctattcatgcgcgccgctccgcgcatccccgtctttttcagctccagtcgttgttgctgcgcatggcgctactcctcaccgttggcgtcaggtggctccctcgtcccccaacgactcttgatgcggtccgtcgcgacagggcagaacgctaggccgcgttcattcccttttccagtggatcgtgtcgttatgagcataatgcgggaacagattcgaggatggtcactgacggtttccgaatggcaactgaatgcgatcaaaatgtgctgccggatacaattttcattgtcattgcaggggccctggccagtgcgggaaccctgcggagccggtatggacaaagtgtgaagccgatctgccggagatgcgaacgcgtgtcccccgatcgctcgataagctcccgatatgccccaggaatcgcatctgacccacgtcgacgagtcgggcgccgcccggatggtcgacgtgtccggcaaaacggtgagcgaccgccgtgccgtcgccgccggcgcggtgcacaccaccgccgaagtgatcgacctgctccggggtgacaacctccccaagggcgacgccctcgcggtggcccgcctcgccgggatcatgggcgccaagaagacccccgacctgattcccctctgtcacccgatcgggctgcacggcgtcaaggtccagctggaactcggtgccgacgtcgtgcacatcaccgccgtcaccaagaccgcggaccgcaccggcgtcgagatggaggcgctcaccgcggtcgccaccgccggcctcgcgatgatcgacatgatcaaggcggtggacccggccgcgagcctcgacgcggtccgcgtgctccgcaaagagggcgggaagaccggcgactgggtgcgaccggagaaccgcccgtgaccatccgggcccgggtcatcgtcgcctccaaccgcgcggcggccggcgtctacgccgacaccagcggcccccgcctcgtcaccggcctgcgcgagctgggctgcgaggtcggcgaaccggtcgtcgtcccggacggcgagccggtcgccgaagccctgcgcgccgccgtcgccgaccgcatcgacgtcgtcctgaccagtggcgggaccggggtcaccccgaccgaccgcaccccggaggcgacccgcggcctgctcgacttcgagattccgggcatcgccgaggcgatccgcgcctacagccgtgaccgggtcccggccgccgccctctcccgaggtcttgccggggtcgccggccgcaccctgatcgtcaacctgcccggctccaccggcggcgccaaggacggcttggccgtcctcggccccctgctggcacacaccgtcgaccagatccgcggcggcgaccactgagtcctgtcccgcgccggggtgctgtcccgtgcggattaggctcgaccggtgagcactcctgcgattggctgggaccgggcccgcgagctcgcccaccaggccggcctgaccgccgccaccggcgtcgagcggatcccgctcgctgacggcgacggacgcaccctggccgagccgctgcgcgccctgaccgccctgcccgcgttcgccacctccagcatcgacggctgggcggtccgcggcgacggcccctggcgccgggccggtcaggtgctggccggcggcaccccgcccccgctcaccgaggacggcacctgcgtcgagatcgccaccggtgcgatggtcccggccggcgccgccgccctgatccgggtcgaggagtcggagatcggcgctgacggcacggtcaccggcacccctcgtcccagcccggagtggcgcctgcccggtgaggaggccgccctcggtgaggaactcctgccggccggcacgccggtggacccggcggtcatcggcgtcgcggccacctgcggtcacgagcttctggcggtacgccgtcagccccgcgccgccctgctcgtcttcggcgacgaactgctgacctcgggccggcccggcgacggccgcgtccgcgactcgctcggcccgcaggtcccgtcctggctgcggcgctgcggcgccacggtcacctcggtcagcggcccggtcaaggacaccctggacgcccacgtcgaagccgtccgcgccgccctggacaccgccgacctgatctgcaccaccggcggcaccatgcacggcccggtcgaccacctgcatcccgccctgaccgagctcggcgcggagtacgtggtcaacacggtcggcgtccgccccggcttcccgatgctgctggcccggatccccggccccgacggccgcccccgcttcctggccggtctcccgggcaacccgcagtccgcggtgatcgccctgatcagcctggtagccccactgctcaccggcctggccggccgcccgttccgcgccgaccttccgctggtgaccgcggcccggccgatcccgggccgcggccgcgacacccacctggccctggccaccctggatcacaccggccgcatcgccaccccggccggccacgtcggctccgcgatgctgcgtggcctggccaccgcccacggcttcgccgtgatccggcccggcgtccgggtcgaggccggcgacgacgtcccgttcctgcctctcccgctgcttcccggcgagcgcccgtgaccaccctgaaccgccgattccttcctggagagcgcgcatgaccagtcccgcagcggccacgccggagaccggcccggacgtcgaaccggtggacaccgccgaacggcggtcacgggtcgtcctcgccgaggtgctggacaccccactggatctggccgcgcacgaggccgccgtcaccgaccgccgcgccggcgcggtcgtctccttccagggcgtggtccgggaccacgaccacggcaggggagtgaccctcctcgaatacgaaggtcacccgtcagcacccgccgtgctgcgcgaggtcgccgaggagatcgccgccgaccccgccgtctacgcgatcgccgtctcgcaccgcatcggcccgctggagatcggcgacgtggccctggtcgcctcggtcagcaccgcccaccgcgcggccgccttcgcggcgtgcgcccgcctggtcgacgaggtcaaggcccgcctgccgatctggaaacgccagctgttcaccgacggcgccgaggaatgggtgaactgcccgtaggcgggtcaaccaccccgaggccccgggatcgccgccgcccggcgccccggcccgggccgatcccacatcggccccggccgccagggcagcattcccaccagcacgaacaacgccaccgcgtacccgtcccagcggagcagcacccccggcgtggcgatcagcagcgcgtatccccccacggtcagcccgccgagcaccgcccgccccgcccgcccacacccggtcccgcccgccatgcggcggcccaccacccggtcggccatcaccagcacggcgggcagcagccacagcatctcggccggcgtcgtcatcggtccgaagccggccgcggtcagcccgatcagggtgaaggcggccacctcgtcgccggccaggttcgcggtccgggcccggatgaggccgacggcgagcagcatcgcgccgaaggagagccagaccagtacgggtggcgccgggtagccgtagatgcgcgcgagcattccggcgagtgcctggttgtcggatgcgttcaggggttcggtgcggttgagttcccacagggtgtcgccgaaccaggtgaccgtctcgcggggtgcgaagagcagcccggcgagggtgacggtgatcgtggtggccagcgcggtgaccgcggcccggcgttggcgcagcacgaggagcccggcgaggaagaacaggggggtcacggagaaggcggcggcgagtccggtcccgacgcccgcccatgatccttcggtccagccctggcgcagccgttccggcaggtggtcgggtgggtgccggtctgccggggtgggccagtgcagttgccggcgcagggcgacgaggtcggcgacgatcaggccgaacagcagcaactcgggccggccttcgccgagggtcgcccggacgggttcggtgagcagggcgagggcggccgcggtgagggcgatcggggtgcgccgccgccggtgtcgccgggcgatcggggtggtgagaacgacggcggagagcagtagtgcggcgacgctggtgagggcgagtagccagccggccgccttcagcggcagcagggcgaggggcgccaggatgatggcgagtccgggcggcagcgcggcaccggcctgtgttccgggttggcggtacgtgtacagcccgccgccgccgagccagtcccgcaccgccgcgtgggtcaccgcgagggtgctcagcccgtaccgggaaagcgtcagtgagatgagcgcgagggttccgagtgcgccgacggtgaccagtgcggatctggttctggtggcgcgtggagcgcgtcgctgggtgaccggcatggcgcgacccccgtctcgtcctccgggcatggcaccgcctgcctctggtgcacggtggccggtggtgaccgggcgggtacgagccggccgggtcgggtgatccggccagctcgaagaccgtccgtgcggcccctcgtccgctttaacgcaaaggtcggctcaaggttgttttccggacaatttggacattgggtcgtacgggtcgagggcgggggtgttcagccgggcagcttgcgtgccgcgccggcggagagcgccgcgatcttcgcctcccgcttcgcggtccgcaccgcgcgacgcacctcgcggcgtgaccggtccaccgcatgggtgagcgtccgctgtccgcgatcgaccgcgtgggtcgtgcgataccgcagacccggctcgccctcggtgtcggccgcggcgagcaacaacccgccgagcagccccaggttcttcaagaagtgcacctgctgctcggcgcgctgctccggcggagccgcccagaacggatgaccggcgtacgtcgtcggcagcagaccggcggccagcacggccgccgcgggccgggtgagccggccggtggccagggccagaccggccagcacgtcggtgccggccttgagccggaccagggtggccgggtcggtgggcaggcgcgggtcggccttctccagcagcggcgtgaaccggtcggtgacccggcgggccgcctgtatccggccctcaccgggcttgatcagcacgcggaccccgctgatcacgaagatcgaggcgagcatggctcgggcggcggtgcggacgggcttcatgaactcccttatacccgtccggggccgatcacaccggctgtgttcggaggtaccggccgaagtgcgggacggtgaaggccaccgtgccccgctcgcccgagtagatgagtcctttcttgatcagggcgtcgcgggccggcgacaggctggccggcttgcgtccgagcgaggtggcgatgtccgaggtcggcaccgcggcgtccatgtcgttacccgggtcgccggagaggacggccattgcccgcatgtactcccgctcggccggggtggcgcgctcgaaccgggagccgaagaagccgaccgccagttcgctctccgcctcgggcgccgccatctgcacgtcgccggcggtgatcggggactgcggcgcgtgatcccaggtggccttcccgtacgcctgcacgaagtacgggtagccgcccgacttctcgtagagcaggtcgagcgcctcctggtcgtagtcgacgccctcccgttcggccggcacgcccagggccaggtcggccgcgtcccggtcgagccggtcgatgcgctggtagcggaagaggcgctcggagtaggacttggccgcggacagcaccgcgggcaggtggggcagcccggccccgaccacgatcagcggcgcgccgagctgggacagttcgtggcaggcggcgcagagcgcggacacgtcggtgccgctgaggtcctgcatctcgtcgatgaacagggcgatgccggtgcccacgtcggtggccaacgacgcggcgtcggtgaagagctcgaccagatcgatttcgatgtcgccggagtcggcacgaccccgagccggcggtacgtcgatgccgggcgcccaccggtcccgcagtttcccggtgctgtcgttggcccgcaacgcgaacgccttcagcacgccgagcacctcgtcgacccggtccgggtcgcggtggtgcggggcgagctcgcggatcgccatgtgcagggcgccggaaaccgggcggcgcagcgactggtccggccgggcctcgatcttgccggtgccccagagccggccgatcgccgccgagcgcagggtattgagcagcaccgtcttgccgacgccgcggagcccggtgagcaccaggctgcgttccgggcggccgcgggcgacccgctccaggacgacgtcgaaggcgtccagttcgcggccgcgcccggccaactcgggtggacgctggccggcgccgggagcatacgggttccgcaccggatccatgacgtagcaccgtatcgggccatctaggacgaacgctagagtccgctcgatatgtcgctctaaagctgtctagcgcctccgctagacagggctagagcgggtcatagtcactccggttggtactcgcgcaggcacagcacgaagtcgacatcgtcgtactcggtgtcgtagtagtaccacttggtgtacccgggaaccttcgcgcacttggcgatcgcgtccttttcgcccgtggtccggccgtcgacccgcttcagcacctcgtaggtgttcgccgcgcaggccacgatccgcagctgaggttccgcgttggtgccctcgttgcggatgcactgcccccggttggcgaaccgcgcgtcggcgctgggctgcacccggggcacggtcaccccggccggcggcgtcgaggccgcggtgcccgcccggtccttgcggcccagcacgtaccagaccgtggtggcgagcccgccgccgaccagcacgctgagcaccgcgatcagggcgccgaccgcgaagccgcgccggctcggcccggaccttccggcggccggcccgggcgccgaggccgccggggaaccggagaactgctggtgggggatctgcggggagccccatgccggatcgttgacagcgcggctgctctcaccccagggatcggagggttccgcatacggctcctcgggccgcccgccggaccagggcggaccggagtatgggccgttgtgcgacatcggaaatcctccagaagcgggcaacgctgcctgtcacggtagcgtgcgccgcctgtggaaaccgcgccggaatgcgggtccggttgtccacaacccgacctgcaccgagccggcgcggccgttaccttcccgggctgtgtccccactactcgtgatctcggccggggcggccggcggtgtgacggcgtacctcatgacccgtcaattctatggtgttttgtcgggttttctggtttccgccctactggctgcacgctgtggcccggttccccagctcgcggtgctgctgcccgcggccgccatcggcgtgcggctggcgctgaccgacctgcgcaccctccggctgcccgatccgctggtcgtcgcgctggccctggtcaccgggcttccgctggccgtgctggcgcccggccggatcctgccggccctggcctcggccgtgctggtcggcctcacctacctggtgctcgcgctgctgcccggacgcggtctcgggctcggcgacgtgaaactcggcgcggtcctcgccctgctgctcgggctgttcggcggatggcccgcggtgctcaccggcttcgcggtcgcccacctggtcggcgggctgaccgcggcctacctcatgatcaccgggcggggccgggtgttcccgttcggcccggcactgctgctcggcgcgctcgccgcgatcacagcagcctgagctgccgatccttcggtttcgccggggctgcctcgcccaaccgctcgaacaacccggagtcgatcacgtcgaggaacggcgtcggctgttgctcccgctcactgccgtgccgcgaccgcttcgccgagtggctcacgtagagccggtcctgcgcccgggtcaacccgacgaagaacaaccgccgctcctcggcgatctcctcatcggtcggcgtcgcaccgggccagcgcagcggcagcaagccgtcctcgcagccgaccaggaacaccaccgggaactccaggcccttcgcggcgtgcagggtcagcaggttgaccgcctcggcgcgcggatccagcgcgtccacctcggcgccggtctccaactgctgcaggaacagcggaaggtcgtcgccggcccgctgggccagcggggtgagcaggtcggccgccgaccagatgtcctccggggcgatctggccaccgtccagggtcggggcggcataccgctgggccagcccctgggcggcctgcctgacccgggcggcgagggggccgctgagaccgccggcgtgccgcagctcgcgggcgatcacctcgacgccgggccggtcccgcagccggttgtgcgaccgcttctgtaccgggatgccggcccgggagagcgcctccaggatcggcccggactgcgcgtcggtgcggtacagcaccgccacgtcggagaaggacagcgccccggcggtggccgcgcgcgaatccacccggcccgagtccaacgaccggtgggacaggccgccgaccagctcgtcgatggtgcggaccacgaagtcggcctcgtccgagacgctgcgggccggatagcggccgaccagctgcgcctccgggtcgagccgggccggatccaaccggcggccgctgaccagtgacgacggggcgatcgcctgcaccgcggcggccaggatcggcgccgacgagcggtagttgcgggtcagccggaccagccgggcgtcgacgaaatcctggttgaagcgcaggaagtagcgcacgtccgcgccgcggaacgagtagatcgcctggtccgggtcgccgatcgcgcacaggttcccgtccgccggggacagcagccggagcaactcgtactgcagttcgtcgacgtcctgatactcgtcgacgaagatccattgccagcgtttccgataccgctcgaccagggcaggatcctcgcgcagcagcgccaccggcacgctgatcagatcgtccaggtcgaccagatcctgctggcgcagcagcttccggtatgcgctctcgtcgtcgccggcctgctcccgcgcctgcttctgctcgggctcctcggcgatccgccagccggcggtcaacccggccgccttggcgttctccttcaggatggtcaggcccagcgagtggaaggtgcccacggtgatgtcctcggccacgtcgccgagcaggctctccaggcgctcgcgcagctcggccgcggcccgccgggtgaacgtgatcgccaggcagcgctccgggaagacgccgagctcggcgcagagatacgcgatccggtgggtcagcgtgcgggttttgccggtacccgggccggccacgatcagcagcggaccgccgggggccgaggcggccacccgctgcatcgcgtccagccggtcgagcaggccggtgccgacctcctccatcccggccagcatcggctcgaacggctcgtgcgggctgggcggcggggcgatcggcggcggcgccggtttcgccttgaccggcttggccttgggcttcggcttctccgcggcgggccgggccggcgccttcggctcggggaacatgtcgaacagcgtctcgacctgcggggcgctcgaccggttgcgcagctcacccggctcgaacagggtgatcaccccgtactcgccgtcgtagccggcaacccgtcgcacgtcgccgcgccgcagccgggtgatcgcctcccgcagctcgtcgccgccggccttgccgatctcgtcgaccggcaccttgcgcaggatgtccagctccgcgccgagcgtcgcgaccaggtgggtgagttgcgactcgacggtcttcgacttcgggccgacgccgtggatctcgccgaggatctcgtgcagctggatcaggtgctcgacgtggacgtcccgggtgaaaccctccgggcggtcggccaggtcctcgacccggctgagcacgccgacggtcagcgggcggccgcactccgggcagaggccgccggccgcacgggtgcgttccggctcccagttgacgttgcaggcgcggtggccgtcggcgtgatacttgccctcctcggggaagaattcgagggtgccggccaggccgatgccgtcccggacggcgaagtagtccggggcgccggtgaacagggtggcctcgcgggccagggcgccgggggagtgggcgtccgagttcgacaccaggcggtagcggtcgaggctggagacccgccagttcatcgccgggtcggaggacaggccggtctccaccgcggtgatgtggtcggccaggtcggcgtagcagtcggcgatcgcgtcgaagccggatttcgaaccgagcgcggagaaccacggggtccagatgtgcgccgggatcaggtaaccgccggcctccagggtgatctccagcaggtcgcgggagtccagcccgaggatcgggcggccgtcggcggtcaggttcccgatccggccgagcgcggtgttgatccggccggccgactcgaagtcgggggcatagagcaggtggtgcaccttgcgggtgcggtcgtcccgcttgtagatcgtggagatctccacgctcagcatgaaccgggccggtgcggtgccctgcagcgaacccggcagtcgccgggtgaccggctgctcgtcgccgagccggaacaggccggactcggcgggctccaggctctcccgcagatgctcgaaccaggccgggtgagtgaagtcaccggtgcccagcagcgcgatgcccttgcgccgagcccaccaggccaggttgggcagcgtcaggtcacggctgcaggcccgcgagtaccgcgagtgaatgtgcaggtccgcgacgtatgtgtccgggctgacctccacgtctcgcatcctgtcacggccgtcggttccgccacgaatcgccacgctcaaacacacttaccgatcttgatgagttacgccacgcggagttcgaccaccgtgacctgcggtggcgcccccacgcggaccggtgggccccagaaacccgcgccgttggtcacgtaaaccggcacgccgtccacctgtccgaagccggagactaccggttgctgaagcttcacgacgaagttgaacggggccatctggccgccatgggtgtgcccggacacctgcaggtccacgccgtagggcgcggcctgccgggcggccagcggctgatgcgccatcagcaccaccggccggctgacgtcccggtcaccgagtgccctgccgaagtcggccggatcgccgtagtcctccccacccaggtcgttcactccggccaggtccagcccgtcgatcgcgacccgctcgttgcgcagcggccgcatgccgagctcggccacctcgtcgatccacggccggaagccggagtagtactcgtggttgccggtcacgaagtacgcgccgcgtcgcgactcgatcccgcgcagcggctcggcgagccgccccagttccgcgacagtgccgtccacaaggtcaccgacgacgcacaccacgtccgcgttcaccgcattgatcacccgggtgatgcgctcggtgtgcccgatcccggtcagcggccccagatggatgtcggacaccacggccaggcgggtcccgtccatgctgcgcggcaacttggcgatcgggatccgcacccggtcgatccgtggtgccccggtggcctcccgcaccccgtagccggtgacacccgccgcggtcagccctgcgaagatcgccgcaccgcgcgccagaaccagccgccggtcgatccccgcaggcggcccgccgtccgccggcgcctcgccggctgccgtcggcagcggtgcacccggcgcaccgctcggatccgccgcgccggacccggtcactccggcgctgccctcggccgggacggccccggccggctgcaactcaccgtccgcgacgccgccccggaccagcggtcctgcggcgcttgcggcggtacgcccccggtctgcccacagcacccgcagcaccagccgcgggatctccagcacggccagagtgatcaccaggtagaacagcacggcgatccacaggtaacccggccaggccagccacttcacgtgtccggcccgcaccccgatcagcgtcgccggtaccagcagcgcgagcaccagggccaccaccgtgcccacccgccgcccccaccgggatcgcagcgtgtcccggacgagccgtttccacacgtaggcacagatcagggcgaagagcagcaagatgatcactgcgacgaacgccaccacatccccctccgagcgagccggaccaagtctccccgacccgccccgctctcacacaccgcacccacgcacctaacgaccgtcccgtcgcgaccgggcgtccatcccagccactggtgatcgggcgccggtcatcccggtcgtaagggatggcggaacgcggcaggtcgcccgcaggccggcgtccggagcgggccggggcccgccggtgacggcacgggtggccggtcagccgccggcgaagggcggcaggatgtcgaccgtcgccccggcctgcagcggcgcccgccggtcatgtcgggtgagcccgtccaccaggaagctggccgccgtcaggacgagcccgaggcgctccccgtgccggtcggtcagcagtcggctcagctcgtccagcgagccggccgccacctcctcggccgacaccccgccggcggccgcccgggctccggcgaaatagcgaacggtgaccaacaggctcatcctccgatggcggacatgggtcgggcgggctgcaggaacgccgggtcgtcgatgccgtgaccggctcgcttgcccgacatcgcgacccgccaggactcggcgatctccacgtccggcgccccgtcgcgcagcagcttgcgcaggtcgctctcctcggtggcgaacaggcagttgcgcacctggccgtcggcggtcagccgggtgcggtcgcagtcaccgcagaacgggcgggtcacgctgccgatcacgccgacccgagccggcgcgccggccgcgtcgacgaagccggggaccagccaggtctcggccggagccgttccacgtgaaaccacgtcgggacacagatcgaagggcttgagcgcggccaggatctcgtcggcggtcaccatggtgtgccggtcccactgatgctgcgcgtccagcggcatctgctcgatgaagcgcagctgatagccgtgctccagcgcgaaccgcagcagcggcgcggcctcgtcgtcgttcaccccccgcatcagcacagtgttgatcttcaccggggtcaagccggcctcggcggcggcgcgcaggccgcgcaacacgtcggcgtgccggtcgcgccgggtcagcgatcggaagcgggccgggtcgagcgtgtcgagcgagacgttgacccggtcgaggccggcctcgcgcagcggcccggcgagccgctccaacccgatcccgttggtggtcaccgacatccgggggcgcggccgcagcccggccgtcgcggccacgatgccgaccaggccgcggcggatcagcggctcgccgccggtgaatcggaccccggtcaccccgagccgctcgaccgcgatccgcaccagccggatcacctcgtcgtcggtgagctgctcgggctgcggcatccaggccaagccctcggcgggcatgcagtaggtgcaccgcaggttgcaccggtcggtgagggagacgcgcaggtcggtcgcgacccggccgaagcggtcggcgagcgcgatcacggccgccaccgggcccgttcggctgttctccacatctcgctcacgaatgcgaatctagccgcttcccggcccggttgccgctaggcatatcggccggtggacgatggcccctcgaccctcatccgcgcaggacggcgcgggcggccgccaccaccgcatcgcggtagcccgccccgaaggccgcggtgtgcacgagcagcaggtgcagctggtgcaacgggatccgccgttcccacccgtcggccagcggccattcggcccggtatgcgccgaggatcacatcggcgtgcgccacgccgccgaagagcgacatcgtcgcgaggtcggtctcccgatgacccccgtgcgccgccggatccaccagccacgcgcgcccgtcggccccccacagcaggttccccggccacaggtcaccgtggatgcgcgccggcggttcctccacggcgtacgccgcaatcgtcttgatgatctcctcgaccagtgcggcgtcggcgccggagagcgcaccgcgatcgaccgaggccctcaggtagggcagcagccgggtgtcggcgaaccagctgctccacggccccgcggagggcgtgttgtcgagcgggagcggcccgatccagccgggccagggcgcgccgaaggtctccgcgccgctgcggtgcagcgcggccaggccgcgcccgaaggtctccgcggccgcacggccggcggcaccgggttcgatccattccatcgcgatcatgccgggcagcgccaccacgatttccggtacgggtgtcgcccccgccgcgcgcagccagcgcagtcccgccgcctccgcggcgcacgacgtcgcggtcttcgcgaacagcgacgtcccgtcgtcgagggtcagccgggacgtcgaggtgactccgcgatggatcggtgtctcccggatccgctggtgggtgagaaatgtcgggaggtgctccgggtgcgcgcgcagatacgccatgtccacccggttatcttgcgcttcgggtgacggacatcccatttcagaggcaaaatgtcggcatggcccctgtcgtagtgcgttcgtaccggccgagtgaccactccgctggccggcggctgtgggctgagctcacccggcagcagcatcagatgtacggcgagtccgatgacgacggtggcgccggtttcgaggagtatctgacccgtctcgacctgtccggcctgtgggtcgccgaccacgccgacgacggggtgatcgggatggtcgggctgatcatgcgcaaccgggccggtgaggtcgagccggtggtggtcaccatcacccatcggcacaagggcgtgggccgccgcctgctgcagcacgtcgccggcgaggcgaagaagcggaacatgacctcgctgaccatctccccgtcgtcgcgcaacgtggaggcgatccgcagcctgcatgccgccggttacgacgtggtgtcgtcgatcgagctcaccatggatctggaccgccacgcccacgcctggcagcaggagggtctggagctgcaaggcctgccgttccgcaactgacggccgcgcccggcctgtggacgagttgtccacaggcgcgccggatggcacgcgccgctcccggccgccgggccacgctgccccgcatgacacccgactgccgcctcgccatccgcaacccgtccgagctcatcgccgtcgtgccgttcctgatgggctatcacccgagtgactgcgtggccctggtcggcctcgcccgggaccgggtcgacttcgctctctgccacgacctgcccggcccggactggaccgacggcgacgcccgggccgcggccggttcggtggccgacgccgtggcccggcagcgggcccgcaccgtggtggtgatcggctacggcccgcccggccgggtcagcccggcggtgctcagcaccgcccaggcggtccaggaccgcggggtggaggtgctggagatgattcgggtcaccgacggccgctggtggtcctacacctgtgccgacccgctctgctgcccacccgagggcatccgctgcctgccgggcgacagtctggtcgcggccgaggcgacctatcacggcagggtcgcgctgcccagccgccgggcgctgaccgcgcaggtggccgcggtcggcggggcggagcgcgaggcgatggcggcggccaccgagcgggcccggcgccggttcaccgacctgatcgccgacgatctgagcgccgaccgctacggcaggctgattcgccagcagggcgaggccgcggtgcgcgccgcggagaaacgctaccgcgcgggctcccgcctggacccggacgagaccgcctggctgggcgtgctcctggtgaaccgcaaggtggaggatctcgcgctggaccgggtgaccggacagggctggcagatccagctctggaccgatgtgctgcgccgcgccgagccggcctatgtcgcgccaccggcctgcctgctggcgttcagcgcgtggcgggccgggcacggctcactggcccgggtggcggtcgaccgggcgctggccgaggagccggagcatcagctggccggcctgctgcacaacgtgctgggccacggtctggccccgcacatggtggtgctgccaccgcgaggggctggcccgtggcggccgttcagacggtgacccgctccgcccgagagtagacgttcatcgtcgacccgcgcaggaagccgaccagcgtcatcccggactcgtcggccagctcggccgcgagcgtgctcggcgccgacaccgcggccagcatcggcagcccggccatccaggctttctgggtgagctcgaaactggcccgcccggagaccatcagcacgtgcccggccagcggcaggcgcccgtcgcgcagggcccatccgagcaccttgtccaccgcgttgtgccggcccacgtcctcgcgcaggacgaggagctcgccggccgcggtgaacaggccggccgcgtgcagcccaccggtccggtcgaaggtgcgctgcgccgcccgcagccggccgggcagctcgaccagcgtggcggccggcacccgtagcgggtcggcggccacgtcgaaacgcgaccgggtgcgcaccgcgtcgatgctggcctttccgcacactccgcacgagctggtggtgtagaagttgcggctcagatcggtgaccggcggcggcacgtgcgcggcgagcacgacatccaccacgttgtacgtgttgggggtgtccgtcccggcgcacagctgagccgtgaccacgtcctcggcggcgccgatcatgccctcgctgagcaggaaacccatcgtcaggtcgatgtcgtgcccgggggtgcgcatggtgaccgcgagcggttgccggcgcacccggatctccagcggctcctcggccgcgagctcgtcggggcgctgccggcgatcgcccggagccgcaccgagatcgatgcgcaccaccggccgccgcgccgaattcctccccatgaggcggagcttacgacccacgctgtccgagcgcgtggtcacgtccgccacccggtcgggatacggtactcacgtggggggatttgcggcggtggtcctggccggtggtgcggcgcggcggatgggtggagcggacaagccgacgctggccgttgccggccagtcgatgctgacccgggtgctggccgcggtgcacgacgctgacccgcgggtggtggtcggccgggtctccgccgacctgcccgttccggtgcacgtgacccgggaggagccacccggtggcggcccggtggcggccgcggcggccgggctcgcgctggtccccgagaccatcgcgtacaccgcgctgctcgccgcggacctgccgttcctcaccggagaggcgatcgacgtgctgcgcctgaccatggagtcggcgccgatggagggcgcggtctaccgggacaccgacggccggctgcagatcctctgcggggtgtggcgcacggctgccctgcgcgccgcgatcgaccggctcgccgagcggcgcggcggcctgcacggcgccccggtccgggagctggtcgagcagttgcgggtcgccgaggtgtcctggcgccgccccggcccgccgccctggttcgactgcgacaccgacgacgacctgcgcactgccgaggagtgggcgagatgagcgagctggacaggtgggtcgccgcggcgagcgccgagctgggcgtgccgcgcgaggacgtggcggtcacgacggtgctcgacatggcgcgcgacgtcgcgcacagcgtggtccgccccggcgcgccggtcaccgcgtacctgatgggcctggccgtcggccggggcgccgacctgaccgaggtcgccgagcgggtcaccgcgatggcgctgagctggacaccggccaccgaacaggcctaggccgtccacagcacggccgcgctcgatagggtgacgggaacggaggtgcgatcatgacggcagaaggcgtggcggcgggcgactcacccgagggcgtgttgctcgacgaaccgaccacggccgacctacgggccaaggtcaccgaggcgtggcgggagttcgccggcgctctggccggggtcctgtcccgcctgcaacccggcgcccaggtcgacctcactctcgaccccaccgcgtccggcaccggcaccgcggtctattcggtcagcatccgggtgctgcccgacggcgtgaccgaggcgctcgcggtcggcaacgccgcgctgcccgccgagttccggatgaatcgggccgccgtcgccgacatggtcgcgctcggctggtccccgcccggcgtgctggccggctccggcgacttcttcggcctgcggtccgagcaggccaaggcgaccgccctggccaccatcgtgtcccgcacgctgcgggacgtctacggtgcgccgcacccggccttcctggtctacctggtgcacgacgacgaggacgagccgatcgacgccggcccgctggccaccgcccggcccgaggccggtctggacgccgggctcgacctgcgcgagctcgatgacgacccgctgctcggcgacatggtggccgacgaggtggtgccgctcgacgagcgggtccgcacggtgatcgccaccatgtcgaagacgacggtcgaccagctccaggtcgacgcggacggtgacgtcgggatccgggccggctcggcgatggtcttcgtccgggtccgggacaacccgccgctggtcgacgtcttctccccgatcctgaccgaggtggagccgaccgagcagctttacgtgaagctgtccgagctgaccaaccggatgccgatcggccggctctactgcgcgcaggacacggtgtgggcctccatcccggtgttcggccgcaacttccaggccgtgcacctgatgctggcggtgcaggtgatgaccggcctggccgacgagttggacgaccggctgcacggcgagttcggcggcaagcggttcttcggcgagggcgacaagccggccgcgcccaaggcgagcgacggcgagcaccgcaccgggatgtatctctagtaggcgatcagaacggcatctcgatcagccgggacaacacgatcatgctgcgcgtcgaggtcacgaagggctcggcgcgcagccgttccaacgcctgctccaggtgaccgatgtcggccgcgcgcaggtgcaccagcgcatccgcctgacccgacacggtgtacgcgccgaccacctcggggtgccgccgggtggccacggtgatctgcgccggggtggtccgcccggtgcagaacagttcgacgaaggcctcggtcgtccaccccagtgcctcgggttcgatcacggcggtgaatcccttgatcaccccgaccgcgcgcaggcggtccacccggcgtttcacggccggggcggacaatgagaccttggcgccgatctccgcgtacgaggcgcgggcgtccgcgacgagcaacgcaatgattcgctggtcgacggcgtccatctgcaacgattcgcctccgaggagcaagatttcgagctgtttgacgcctcgcagcctacctacgctaaaacctcatgagccagcaggagcgaaagccgcgtaccaggacatacttgatgtgtcccccggagcacttcacggtggagtacgcgatcaacccgtggatggacaccgcggtcgcggtcgacgccgcccgcgccgtgaagcagtgggagtcgctccgcagcaccctgatcgatctcggccacgtggtgcacgtgctcgacgcccgtcccggcctgcccgacatggtctactcggccaacggggcgttctcggtggacggcaccgtctacggcgcgcgcttccggtacccgcagcgggccgacgaggcgagcgcgcaccgcctcttctacgaggcggccggcacctggaagttcatcgccccggagcacgtcaacgagggtgagggcgacttcgcgtacctgcccgccgcgtacggcgggatcgtgctggccggctacggcttccgtaccgacccggccgcgcacgccgaggcgcaggaggtgctgggccggccggtgatctcgctgcgactggtcgatcccgccttctaccacctggacaccgcgctggcggcgctcgacgaccggcacgtcacgtactacccggaggcgttctcgccggcctcgcagcaggtgctcgcccagctcttcccggacgcggtgctcgccgaccgggcggacgccgaggcgttcgggctgaacctggtcagcgacggccgccatgtgatcctgaacaccgacgcggtcgggatgggccgcaaggtccgcgacgccggctaccagccggtccacgtcgacctctccgagctcaagcgtggtggcggttcggtcaaatgcgccgtggctgagctgcgcggctgacgccgcgcgccaatgcgaagatgggacgcatgactgacgactcccgcaccaccgagcacaaggaagacggctctgtcatcgtcatgggccccgacggccgcccgatgggcaccatcgaggaggacggcaccatgagtcccgaggagccgggcaacctcatcgagcagcccgcgaaggtcatgcgcatcggcagcatgatcaagcagctgctggaggaggtgcgggccgctccgctcgacgaggccagccggggccggctgcgggagatccaccagcgttcgatcaaggagctggaggacggcctggcccccgagctgcgcgaggagctggagcggctctcgctgccgttcgagggggagaccccgcccagcgagcccgagctgcggatcgcccaggcccagctggtcggctggctggagggcctgttccacggcatccaggccgccctggtggcccagcagatggccgcccgcctgcagctggagcagatgcgcggcggccagggccgcccggcgctgccgatgggcggcatcccgggcaaggagcgccccaccgggcagtatctctagagcccgtacagctcgcggagatagaccgcgacgccgtcgtcgacgttcgccagcgtgacgtcgtcggcgacggcccgcaccgccgggtgcgcgttgcccatcgccaccgcccgcccggcccaggtcagcatcgggatgtcgttgggcatgtcaccgaaggcgaccacctcgtcagcggtgatcccctcccgctcgcagtaccacgcgagcccggccgccttggtcaccccggccgccgagatctccaccagcgccgaggacgacgaccgggtcgcttcggccaccccgtcgagcgccttggtgaccagctccaggaagtcgtccgggtcggcggtgccggagcgggccagcagcttgatcgccggcgccgaggtgagctcctcgggcgcggcgatcacccggacccgcgggtcgggccagcgcagtggccaggccggctcgtgccggaaggctccgtcgaccatctcgacggcgagggtcaggtcgggcgccgcgttccgcagccgctcgacgacgtcgaccagcacctcgctggtgagcgacgcgctccacaacacctcaccggtgtgcgggtcgtggatcaccgccccgttcgcgcagaccgccggcagcggggccggcagctgggcgtagagctcctcgacccagcgcagcggccgaccggtgaccaggacgacgcgcgccgggacggcggccagcacgtcgagggtgacctggctgatccgccgctcgtcgtcgaccagagtgccgtcgatgtcggtcgcgatcagccggtagttccccatcacctggacaatagccggtccaggaacacggccacgccgtcctcgtcgttggtgagcgtcacctcgtcggcgaccgccagcagctcggggtgcgcgttcgcgacggcgacccggccccagccggcccagccgaacatcggcaggtcgttcggcatgtccccgaagacgagcacgtcggccgggtcgacgccgaccgcctcggcgaccaccgcgagcccggtgcccttgtcgacgtgcgccgggcagatctccacgtagtccaggccggcctgggtgaccgtcgcgacgtcggtcggaaccacccgccgggcgatcgccagcagttcgtcgacgtgatgctggaaggaccgggcgaacgccttgatcacgtcaccgtcgaggcactcggcccgggtgcgcgcctccacggtgaccgggtagcgccaggtcgggtcgtagtcgccccagagcggggagtcgtcgtgctccagcgcctcgaacatcaccgagagcgggccggcgaccgactccatcgcggcgagcacgtcggccagaacccggccgggcagccgggcctgccgcaggtatcgcgcctcggtctggtcgagcacccagccaccctgggcgagcaccaggtagtcggcgacccggatgtcgttgcgggtcagtgcggtcaggcgggggccccggccggtcgcggcgacgatccggatgccggcgtcatggacccgacccagcacctcgtgcgtgtaggcggacaccgtgtcgtcgctgcggacgagggtgccatcgagatccgtggcgatgagcttgggaagcccaggcttgagcatcggaacctccgagggttgagcaacccccgcggagggcggaaggagaacggtacacctgcccggccaccagcggctatgacgactggtgaccgggtggtgtcgagatcgtcaacggctgggttcgaggatttcccggccgccgaggaagggctgcaacgccttcggcacccgcaccgagccgtccggctgctggtggttctccaggatcgggatcagccaccgggtggtcgcgagcgtgccgttcagggtggccgcggtctgcggcttgccgttctcgtcgcggtaccggatgttgagccggcgcgcctggaacgtggtgcagttcgacgtggaggtgacctcccggtaccgcccctgcgacggcacccacgcctcgcagtcgaacttgcgcaccgcgctggagccgaggtcaccggcggccacgtcgatcacccggtacgggatctcgaccttggccagcatctcctcctccatggcgagcaggcgctggtgctcctcggcggcgtcctccggccggcagaaggagaacatctccaccttgtcgaactggtggacgcgcaggatgccacgcacgtccttgccgtgcgagccggcttcccgccggtagcaggtggaccagccggcgaaccgggacggcccggccgacaggtcgaggatctcgttcgagtggtacgccgcgagcgccacctcggaggtgccgaccaggtagaggtcgtccgcctcgagccggtagatctcgctggcgtgcgcgccgaggaagccggtgccctccatcgactccggccggaccagggtcggcgtgatcgacggggtgaagccgtgctccaccgcctgctggatggccagctgcagcatgccgagctggagcagcgcgccgacgccggtgaggaagtagaaccgcgagccggacaccttggcgccgcgctcggtgtcgatcgcggcgagcgcctcgccgatctccaggtggtccttcggttccgcgatctccgggatcggacccacctcgcgcagcaccacgaagtcgtcctcgccgccgggcggggcgccgtcgaccacgttcggcaccgcgaggtgcgcgcgcttgagtgcctgctcggcctcaccggccgcggcctcggccgccttgaccgcggcggccagctccttggtgcgcgtcagcagggcggcccgctcgtccccggaagccttggcgacctccttgccgatggacctctgctcggcgcggaccgtctcgaaccgctgggtggcggaacggcgctcctcatcggcacgcagcaggtcgtcgaccagctcggtggactcgccgcgcagccgctggctggcgcggatcaggtcggggtcgtcgcgaagcagacgcaggtcaatcacaggggtcaagcttacgcggtgcggcctctcattatcggaggtgtggtttgtcccgattgtcgagcgtgtgggcgaacggcgcggtcggcgtgatgctcaactccagcggctcgtcgtccggcgccgccacagcccgcgccgcgaccggcggggcgggtgcggtggcacgcccggacagccagagcgcgagcatcgcggcggtcaccccggccacggcgcaccacagcccgcggcccagggcgaccttcagatgcccggtgtcgatctcgatcaggtagaaccgggagatcagccggctctgcccgctgagcatccggaacatcgccgccagcagcgccagcagcgtcccgccgacgcccagcccggccagccgggcataccgctgcccggccgccggtccgcgcaccgccagcagcaccgcgacaaccaggatcaacagcccgacggtgtacgccgcgccgaccccgtccaggtcgaacaggtcggtcggcagcttcttggtggcgcccacctcgtccgacccgaacgccagcccgtccaccgtggtcacctgccactcggagatcagcgacccgaacgcggccaccgcggccagcccgcccaccagcggcgcgacccggtgatcgcgccccagcccgcgcaggaatccggcccgttccggggcgccgaactcgaccacggcccccgtatccatctccgacatgtgaaccatgatgagccttgggttgtcggacactccatcgagccccggatgggttagcgttttgtccatgcctattcgttctgccacggcccgctgggaagggaacctcaccgagggttccggcacggttaagactggtaagggtggcctgcaggggagctactccttcaagtcacgcttcgaggagggcgaggggaccaaccccgaggagctgatcgccgccgcgcactccggctgcttctcgatggcgttctccaagggcctcgccgacgcgggcttcacgcccacgtcggtcgagacggtcgccaaggtgcacatggacaagaccgacgccggtttcggtgtctcccggatcgacctggagaccgtcggcgacgtccccggcatcgacgaggccaccttccagaagatcgccgagggtgccaaggagaactgcccgatctcccgcctgctcagccccggcgccccgatcagcctcaccgccaagctggtctgaccttctccaccccggccggcgcacccgcgccggccggcagctacccgccggcgcgccctcccggggccgcgccggcggcggcacaatggtcggcgtgccggtggagatgagtcgcgagcgcttcgaggagctcgtcggtgaggccctcgacgaggtgccgcccgagctgctggccctgatgagcaacgtggtcttcctggtcgaggacgccccgccggacggcagcgacgacctgctcggcctctacgagggcaccgccctgaccgaccgcggctgggactacgccggcgtcctgccggaccggatcaccatctaccgcctggccaccctccgggtctgcgactccgagcaggacgtcgtcgaggaggtcgccgtcacggtcgtccacgagatcgcccaccacttcggcatcgacgacgaccgcctccacgccctgggatggggataaacccccgaaaatccgattgcgacggtacgccgtcagccgcccccgccgcgcagcgcgccggcctcgcctccaggtcgtcttgccgctgctccggcagcgtgcccgggccgcgtgcggttcatcggtggctgcccgcaaccccggatgggccggcacctggtggccggtccggcccggcggggccggtcggcgccgggtggcaggccggacctgttgactgggcggcgccccgggtcagccgggctcgccggcgcgcaggcggcgcagccaggcggcggagtcggcgaagtcggtgtcggagaggccggccggcgcccgcaccggtggttccggctgcagccggtgccgggcgtagctgcccaggaagcggacctcggcgcagatccggcgcaggccctgcagcgcctcgcccaggcgggcctcggccacgtgcccggtgcagtcgaggaagaagaagtaggtgcccagctgctcgccggtgggccgggattcgatccgggagaggttgactccgcgtacggccagttcggtgagcaccgccagcagcgcgccgacctggtcgtgccggatcgacacagccagggaggtgacgtcgtcaccggtcggcggcggcggcgcggcgggccgggtgagcagcgcgaaccgggtgaccgcctcggcccggtcggcgaccttctcggcgagtacggtgagccggttgcgcgggacgccgatcggggcgcagagggccgcgtcgtactccccggcggccgcgctgatcgccgcggccgcgttggacaacacgtcgaccacgaccgcgtccgggacgttggccagcagccagcgccggcactgcgcggacgcctgcgggtgcgccgcgacggtgcggagcccggccagcggtttcagcgtgtccgccgccagcacgaactcgaccggcagcagcacctcccgggcgatcatcaggggcgcgccggtgaccagctcgtccagggtgaccgggatggctccgccgaccgagttctccagcggcaccagggcggcgtcggcctctccggaccggaccgcctcgatcgcctcgggcacgctgcgagccggcgtacgcagcccgtgctcggcggccgggatggtgcgcagggcggcctcggtgaaggtgccctccgggccgaggtaggtgaaacgggcgggcggcgttccgggcatcccgtcagtctagggcgcacaaaccccgcccccacgcccgagcggcccgtcgatccagggcgcaccagccccggccctacgcccgagcggcccgtcagtctgggggttgaacaagcccccgcccgttctgccggtctggagcgtacagtcctgatcccgcgccccagcgttgcgtcaatgagagatgcccgcctgccggcatcacgcccctgtgagacgggacggcgggggtgcgggagcggtcagaagccgcaggccatgacgcggatcccggccggggcggcctgcacctgcgcgttgcacacgtcggagccggcggcgaccagggccagcgtggcggctttcccggtggccaccaccatgagcggctccatctggtccgtaccggatccggccagtttcaccgtggtgaacgaccacgtccccgagcagaacggcccgtcctgcacctgcagcgtcttggacgggatcccgggcttgcccttgatcagggccaggatgtccgccgggctcggctgcccgccgcacttggcggcgtgcgccggggtcggcgtcggcgacttggtcagcggcccctcggccggcgtcgtggtcggcagcgtgtaaccggggtggtaacccgggttgtagccgggattggggtaacccgggttgggcatcgtgtatccggggttgggcatcgtgtatccggggttgggcatcgtgtatcccggcaccggcacggatgcccccggcagcggtccggcgccggagggctgcgggccgatcgtgtacgacggcgtgccggcgggctcggatccggccggcgatccgcaggccgccgtcagtagagcggcgcccacgacgagagggacgaagcgggtgtgcggggacacgcgcccatggtaggccctacccccggagtcggctgggcacgaatcggcggcggatcagccggcgatgcggtgaccggcggcgaccagcgtgttgaccgcctcggtcagccggaccgtcggcacgagcagatagtcggtgtcgtaggtggagaacgtgacgatgttgacccgggcctcggccagcggcaccgccagcgacgcgatcaccccggtcatcgccaggtcgagctcggccacgcgcagacatcgccatgccgtgtcgacctcggcgccgtccggcacccggtgggacgggcagatgatcgagatctcgtcgaggccccaggtcaccgagatgacgctcttgtcgtccggacccgtggtcagggaggtgggaaggggtgaaccggccgagaggcggcacaccgcgtactcccctggtaacaggtctagatcgagcatgacggcagactacgttacggataggtaacacccaatggttgtcggatgcggcgaacaccacaccggcacgaacaaaccggatgtcagtagtgcacaggcgacagaaacgtcatcgaaccggccacccggtcgccggcgagcaggggtgtggcgatcgcgtcgacggtcagcggcggtttcccggcgtccggcacgacgcgcatcagaccgcgggccagccgctcactgcgaaccgcgagcagcggcggaatcttctccgcttcgggctcgtcgagcgggccggcgccggccgtgaagtcgatcagccgcagggcggtggacagcagcttgccgatcgcgtcgcccggcttgcccagcccgagcagctcactgcaggacggcgagacggccacgatggcgccgccggcgtcgatgatcaggcagggctcgtcggccaccgccacggtgccggcccagcgctcgatgctgccgacgaactcggcctcggccggtgtgcgtgcctgggggacgaacgctcccgagagggagagctcaacatgcgccacccgctcctcctcgcttccgtcgcgccgaccggggcgccccgatggggccggggcgccgccgtcgacttcgtcgcaaggaacgttaccggcgggtcggccgcttgtcagcggccgtctgtccgttgctgtaccaacggtagtcgccagccggccggtagggcgcgttcgcccaggtggccgggttctcggcgacggccgacagtttgctggcggtggccgccgagatgcgggcaccacccgcgaggagcaaccggtcgagctctttgtcggtggcgacgaggcagtccttgggcaggccgtgcacgctgatcacaccggagccgacgaaggtcaggaccggggtcaccggcacgttcagcccgacggccgcggacagcgccttggcggcccggcgggcgtcccggcgagcctccgcgacgtaccccggccgcttgccgttgatctgcaccacgtcaccggcgatcaggacgcgggaacgcccgtggtcggcgacggtcaccgcgtagacgccaccggggccgatggcgaggaaaccggcgcggtcgtcggccgggtcgggctcgtagtaagactgggacaggtcggcgcgcggccagtccacgatgcgccaggcggagccgaggcggtcgagtcgggtcagcgcgcgggcgccggccgcctccatccgccgggcccctcgttcggcacgacgacgccgcgcccactccaccggagtgaggcgatccagtgtgggcgacggggtcgggccgggtggcagggctcggttggtggcgggcacgggcagagcagggcgggtggggaagacagtcactgcgacctccggcaaaaggtcaatcgggctggctctctggttttccaactaccgtacgtgctcgggtcctcacggaacagggtgacggcagtgaaagaaagagaaagaagtgtggatgaatgccgcattcacggacaacgtcttcttgcggatggtgcatcccgacgcggtttcgtcgcactctgacaacgtatctcttaggtgacccatggtgcatggccgtcccaagatctagtcagaacgtcaccgggcggtagcggttcgtaggggttaccgtcggcaccgtgtacgtcgacagtgaagtcagccaactgcgcaccgtcctgctgcatcggcccggcaaggagcttgcccggctcaccccgaggaacagtggatcactgctcttcgacggcatcccctgggtcggacgggcccaggaggagcacgacgcgttcgccggggcgctgcgctcccgcggcgtcgaggtgctccacctcgaccggttgctcgccgagaccctggccgtgccccgggcacgggaggagctgaccgccggggtgctcgccgacccgcggctcggcgacggcctgcgcgccggggtggccggctacctggccgatcaggacccggagcggttggccgaggtgctcatcgccgggctggcccacgaggaggtcaagccgggcggtggcagcctggtctacgagatgttggagcgccacgacttcgtcatcgacccgctgcccaacctgctgttcacccgggactcctcggtctgggtgcgcgaccgggtggcggtgaccagcctggcgatgccggcccggcgccgggagaccacgctcacccacgcgatctaccggttccatccgcgcttcgccggcggcgacctgctctacgaccccggactggagcacgtcgagggcggcgacgtgctggtgctggccccgcaggtgatcgccatcggggtgggcgagcggaccaccccggccggcgccgagcggctggcccgccgggtgctgctggccggcctggcgcataccgtgctggtcgtgccgatcgcccaggagcgcgccaccatgcacctggacacggtctgcacgatggtcgacgcggacgccgtggtgatgtacccggtggtcgccgacaccctgcgggcctggaccgtcaccgcggacggcgaagagctgatcgtccggccgccccggccgtttctggaggcggcggccgaggcgatgggcatcgagcggctccgggtgatcgacaccggcctcgacccggtcaccgccgagcgcgagcagtgggacgacggcaacaacacgctggccgtggcgcctcgggtgtgcctggcctacgagcgcaacatcgagacgaacgcgcagctggagcgggccggcatcgaggtgatccggatccgcggctcggagctgggcagtggccggggcggcccgcgctgcatgagctgcccgatcgagcgggtgccgatctgagccgggattcgacgacgtccgttcggcggcgacgaggcgatcggcctgaccgtgcgccgctacgaccgggctgccggtctgtggtcgcggtaccgggtgcgcagcggcaccggtgagctcgtccggccgccgacggcggccggacctgggaaccccgctggatcgccgggttcaccaggtcccgcggacgcgcgtcgcggcgccggagagcgccccggtcagcgcagcgtcagctgacggccgatcagaccctgcttggcccggcgccccgccgcgtcgagcggctcggtgatcgccagtgtgtcctggtagcgcttggcgaaatcggccagcggcgcctcccagtcggccgcctccggctcgccggggatgtcccagaccggcaccagcagcccgtgcgcccggaacatcccggcgaacttggtgtcgtcgcgcagcagcagctcgccggccgcggagagccgggccagcgcgtccagcgccgggtcctcgccctcgccgagcacccagcggacgtgccccttgtccggcgcgatccggcaccagtacgccgccttggccgcgctcagccgctcggtggggtagatcgaggcgttggcccgctccagcgacgccttgaccgtggcgtcgtgcagctggtccgcgtccagccagtactcgaagccgtcctgcatggtgatctcgagcgggccgtcggccagcacgtcctgcaggcgggggccctcgccgggcaaggccggcaccgacaccgggtcgcccggggcggtccgcagcgcggcgaggatggccaccgccaggtcccgggagacgtcaccggactgcaggtgccgctggaggccgatgaagacctgcccgtcccggcgggacatggccggccaggccatcgggagcacggtggagagggtgaccggacggtccccgtactcctcgatgatctccggcttcagggtcagtggcgccgaggcggccgggaccagctcgcgcagggcgacccactccggctcgtcggcgagaccctcgaaggggcgggcgacgaagatgtcgcgcaccttggtcctgggctccgactgtgacttacgacgcttgctcacgagggaccagcgtaggcggtgccgtcggaaacgcggcgaggtgggcgcttccagcgcggcgaaaaacgagcaaaagcgcaaaaaatcgctcaggcgcgtcgtagtcgcacctcggcgaccgtcccgccgccctcccgcggccgcagcgacacccagccgtgctgctgctcgacgatccggcggaccaggtagagccccagcccggcgcccggatggtggtgccggtcgccgccctcggcctgccagtaccgttcgaaggcccgctcgacgtgctccggcgcgatcccggctccccggtcggagacccggaagcgcagcgtgtcgtcgtccgccccggcgcagacctccaccgtggtgtccggcggtgagtacttctccgcgttcgtggtcagctcggtgaggatggtcgcgatcgaggcgcgatcgccgtacgccggcggcaggccggccggcaggtgcgcgagcttgagccgccgccgcaggtcggccggcagctcgtcgaccgcctcccggagcgcttcgaccaggtcgaacggcccggccggggtggcgccggccaccccgtcgctggccgccgagagcagccggtcgaccagccgggccagctcgccggcgcggttgccgatcacccggaccgcctcccggcgccccggctcgccgagcgtctcccagtggttggtgagcgtgtccgcgtaccccttgatcacggtgaccggggtgcgcagctcgtggctggtgaccgcgacccagaggtcccggtcggcctgggccggcggcgcggccgggtgcaccggcaacccggcgccgcgggtgtagagctgcccgatctggccggccagcagctccagcacggcgtggtgctccgggccgggcgggccgtcggcgccgccgaagtagacgtgcagcgaaccggcgaaggcgcccccggactcgcaccgggcgccgagcatgtgccgcaggtcgccgccttcgatctgccgggcgaactcgtcgttgatcgagtccagggccgggtccagcggcaccagcagggtgcggccggcggactccagcgggcggtcgacccgacggccgacggccggctcgcacaccccggtgccggcgatgatccggccgcggccctccgagtactccgcgaagccggcgccgcgtgcgccgagagcctcctgggccaggcggaccagccgctgcaacacgggcaggccggactccccggcgttgacgcggtcgaggaccgcgatctgaccccgggtcagcgagggatagtcgggacgatccggcatgtctgcgagtctgcctcggcgctcacgattccgatgatgtgtcggcggtcacacatggtcgagctcggccagccggtccagcacgaacttgggccggtcgctgatcacgccgtcgacccggtgccgcaggaccaggtccaggtcgtcgggccggttgacggtccagacgtacgtctggtggccggccgcgcgcatcgcggccggcagcccggatcgggcccggaccaggtcgacgcccgggccggcgatccgcgcgccgaacggcaggcgccccttgccgaccatcggcgggagcacctccagcaggtacacggtgggcaggccgggggcctgggcgcggatccgacgcagcgccagggcggcgaaggacatcacggtcacctgcaccgggtcgtccggcttcgggtcggccagaccgtagcggcgcagcagtttcaccaggcgacgctcgacctccgcgccgtacaccgaagggtgcttggtctcgatcagcaaccgcaccgcgcggccgcagtcgcgcaccgcctccagcaggcgttccagggtgagcagccggctgaggtcctcgtccggctcgtcggcggggtacccggggtgccaggagccgtagtccagctcgtcgagctccgcgagtgtccgccggctgaccaggccccggccgttgctggtgcggtccagcttgcggtcgtggaagcagaccaggtgaccgtcgcgggtcagccggacgtcgcactccagcccgtcgaccccgtcctgcagggcgcgcaggtatgccccgagggtgtgctcgggcagcgcgtcggcgcccccgcggtgcgcgaacaccagggggcgatagccggtgctcacaccacccgggccggctgcccgtcctcgctgaccatgtccttgccggcggcggcccaggacttcatgccaccgtcgaggttgcgcacgttgtcccagccgttgttcatcagataggcgacgacctggccggaccggccgccggcccggcagatcaccaccacctcgccgtcgctgggcacctcggccatccgggccggcacctccatcatcggcaggtggtgggcgccgggcgcgtggccggccgtccactcgtccgactcgcggacgtcgagcagataggcgttggagtcgacctgatccggggtcacgctgggtacctgaggtccgaacacgggatccagtttatggctgccggtcagctcttcttgaccgggttggccgtcatccactcggacatccggtccgcggacatcgcctggaacagggccagcgccttctcccggtcggagaccaccacggactgcccggcgatcgtctcgctgcccttgttcgggctggtcaggaacgtcaggttgtcgccgcgcaggctgtggaactgctcgaccatgtccttgagcgagaaatcctggtcgacggtgaccgcggcggccaccgcgttcaggaagtcgttgagcttgcccgggctggtcagcgtgccgccactggccgccttgtccatcagcgccttgaggaactcctgctgatgctgcatccgggcgaagtcgccgcgggcgaactgcttgcgctgccgcacccagtccagggcctgcgccccgtccatgtgcatcatgcccttggtgaacacccggtgcggcgggtggatcgaggtgatgctctggtccaccttcaggtcgacaccgccgagcgcgtcggtgacctccttgaagccgccgaagtcgaccgccatcacgtgatcgatcttcacgtcggtcaggcactcgacggtgtgcaccgcgcggggcaggccaccgaaggcgaacgacgcgttgatcttggcgcgactgccgtcgctgcatgccgcgtcgttgctgcgcggcaccaccacccacaggtcccgcgggatcgacaccagctgggcggtcttgtggtcggccggcacgtgcatgatcatcagcgtgtccgcgcgccaggcgttggcctggtcgtccttggtgtccggatcccgcgagtcgctgcccaccagcaggatgttgaacgcgccgtcgatcggcttggccggccggtccttggacagcccggagaaggcgttggtccgcttcaggtcgccgtcgatcttgttcacgtagtggaacgcgtagatcgtgccgaccagcgccagcaggaccaccgtggcgccggtgaccagggcgatccggccccagcgcgggcgggtgcggccaccccggtaggggcgccccgggcccggctctcgcccgtacggcggtgggacggaagcccgtccagaggagttgccgctggaagaggtggtcgcagacatgctgaccacattaggtcgccaggggtgatgatcccggtgcccgaacccggttcggcacgaaggtgggagtagggcccgggccggcgcggcgacgacgccggcccgggtactttccggaggaaggttcagtgcgcgccgtgcccggtcagcgaccggacctccagctcggcgtacttgtcggcggcggactccttgctgagcacggtgcccagccagccgaagaagaagcccagcgggatcgagatgatgcccgggttggacagcgggaaccagtgccagtcctcgtgcgggaacatcgcggtgggcgagccggacaccaccggtgagaagaacaccaggatcaccgcggtgagcaggccgccgtagatcgaccagagcgcgcccgaggtgttgaaccgccgccagaacaggctgtacagcaccgccggcaggttcgccgaggcggccaccgcgaaggcgagggccaccaggaacgccacgttcaggctctgcgcgaagatcgacagggcgatcgcgatggcgccgatcaccagggcggcgacccgggccacccgcacctcgtcccgctcggacgcggtgcccttcttgatcacgctggcgtagaagtcgtgcgcggtgctcgacgacgacgccagggtcagcccggccaccacggccaggatggtggcgaaggcgaccgccgcgatgatcgccagcagcaccgccccgccggtgtccccgcccaggtagtcgatgccgagcttctgcgccagctgcggcgccgcggtgttgcccgccttgtcctgcgcggtgatcgccttgccgcccaccagggccgccgcgccgaagcccagggccagggtgaacaggtagaagacaccgatgatgccgatcgcccagagcacgctcttgcgggccacccgggcggtcggcacggtgtagaaccgggtcaggatgtgcggcagaccggcggtgccgaggaccagcgccagacccagcgagagcaggtccatcttgctgtagaaggtcttcgtcgcgtcgccggccgtctccaccccgtaccgcaggccgggttcgaggaaggcgctgcccttgccggactgcgcggcggcgtcacccagcagcgtcgacaggttgaaccggtagtgcgccagcaccatcagggtcatcaccagcgcaccggtcatcagcatgaaggccttgacgatctggacgtacgtcgtgcccttcatcccgccgaccaccacgtagacgatcatcagggcgccgaccagaatgatcgtgaacaccttggcggtgctcgcgtccatgcccaggaacttctcgtcggcgctgatcccgagcagcagcgagaccagcgcgccggcgccgaccatctgggcgatcaggtagaagatcgacaccaccacggtggagaccgacgcggcggtgcgcaccgggcgctgacgcatccggaacgccagcacgtcggccatcgtgtaccggccggagttgcgcaggaactcggcgaccagcagcagcgccaccagccaggcgaccaggaagccgatcgaatacaggaagccgtcgtagccgtacagcgcgatcaggccggcgatgccgaggaacgacgcggccgacatgtagtcgccgccgatcgccatgccgttctggaagccggagaactggcggccaccggcgtagaagtcggtcgcggtcttggtctgccggctggcccagatggtgatcgccagggtgatcgccacgaagatcaggaagagcgtgatggtcagcgtccgggaggtgctggacgtgcccgcggcggccatcagcatcagagcacgctcccctcgtcggcgggggcgttctcgatctgccggtggatgtcgtcggcgaccgggtcgatcctgcgcgccgcgaaccgcgcgtagtaccaggcgatcacgaacgtcgagacgaactgcaacagcccgaagagcagggcgacgttgacgttgccgaccagcttgatcgccatgaagtcacgggcgtacgcggacagcaggacgtagagggcgtaccagaggatgaacgcgacggtcgtcgggaagatgaaacggcgaagggtgtggcgcagacgcccgaattcgtcggagttctgcacctcgagatatctctcgggggtggccggcacggtgtcaccaccttcgtgggcgagtggactttccggcacggtacgaaggaaacccgcccaccccgtcgcgccggtcagcgcctgcgctgagtggtggtctgactgcgctgagcggttgtcagcgcagttcgcggtaactcccgcggtggtgcaccagcggcgcgccgggcgcctcgaaggtcaccgcctcgatcaccgcctcgaccagcatcgcccacccgcacggccgggagtccaccaaccggcactgcgcccaggcggtggcgtgcgccggcaccggcccgtacgcggtctcccgccacccgccggtggcgaacagcccgcccggggccggcatcaggccggcgaaccgatcggccagctgtcggtcggccgggaccaacgggaccacggtgaaccgcccggcccgctcggccgccgcccagaaatcgctctcctcgtcgatcaggccgagcacccgacccggatcgccgtcggcgaccagcgtggacgagacggtcagcccggccggcccgggcgcggtccagatcgtcaccggcgcggccaggcgcccgcggaaccggcggaccgccgatttctcctcgtccggcaccgcgaacggatcagtggaatggatcgtcatcggaccattgtcccgattacagatcgtgcacgccgctatcggttttaattgatcaccggctattttcctctggggacctccggcggaaggggatggcgcatgcctcaggtggtgttgcgaccgggtgacgtcgtgcacgtcggggccgaggcgagcgtgcagttctccggcgagcgggcgctgaccttccggatcatccgggtcgacccccgggtcacctacgacggctggatctggctggacggctacgtggtcggtccggccggcaacgcgctgcagcggcgccgcatcttcgtgcggcaggacggcctgcgggcgatccgggtcaaccgggtgcccgcgccacggagcggatcccgtcccgtcggtcgcccctgatcggcggagaaaatgcgctgagctatcgcggcgtcaccgcggcgagcacttccggcatgcggcggtcgagcagatccccggccattccggaaccgaccagataagcggctgccccgtaacccaggccgatcggcagcccggcccagatccaggccggccccagcagaaatccggccaacaccacgggcagcgcgccgaatattccgccggccattccggccaggctcggcagtccctttcccaggccgccgccggacgatatcgagaacgggctggccgattcgggcagtgcgtaggcggcgcgaaccgagatcggcagaagcaccgccagcccggtgccgtacaccgcgagcagcgtgccgagttgcgccggaattcgggccgggtcgccggagagcatcccggtgaccaccgcgaccagggtcagcagcggcacggtgaacagggcgtgcgccgccgcccgggagtggacctccagccgtcccggcacgccggccgccaggttcgtggcgtacgcgccgccgtcgtaaccgaactggttggccagtgcgatcggcgcgaccgcaccggccacgaaggccattccaccggtcagtccggcgcccggacccagcgccgaggtcagcggcaacaccagcccggccatggtcagcgcgaccagcccggcccgtcgccggttctcccgccaccagtaccgcgtctcgcgcgccaccagggcggtgaacctgttccgtggccaccaggggaacatcagccggtcgaccgggccgcggccgtccgcccggacccgcgcgtgccgcccggccgtcgcggtgccggccatcgcctgctccagcgtccggctccaccaccacagcaggccgccgacggcggccagcacgatcagcagtttcagcggtacggcccaggcccggcccggcccgtcgcgacgtccagtcccagggtgtacggcgcgccgagcggagtccagccgatcacctcggcgatcccggcgacgtcggtccagtccgcccggtcgagcagcccgagcagcagcaactgcagcggcgccaccgaggtggccaccacggcgagcaggatggtggccaggtcccgggcccgccgcgaccgcagcgcggtggcgaacgcactggtcaccgcccggctcacggccacgcacaggagcaggccgccgagtaccccggcggtctcggcgaccccggcgaccggcccgccgagccgggccgcggtgtccgtcatcccggccgtggcggccagtgtggcgagggcgggcagaccggcgagagcggccgtgccgagcccggcgaccagggtccgccggggcagcgggagcagggcgaaccgggccgggtcgagcgactcgtcgaccccgaagaacagcagcggcaggaacagccagccgagcagcagcaccgcgccaccgaacggcagcagcatcccggccaggtgcgcgtcgtgcaggtgcccgggcagcgcgaagaccgcgtagccgaggacggcgagcaggctggcggcgcacgagcccagcacgaacagcacgacccgggtcggccggccgcgcagcccgttcgcggtgatccgcagcttgagccggacgaagtggcgcgggctcacagccacgccagctccgagccggtggccacccggccccccaccacctgcacgaagacgtcggagagtgaccggccgccgcgtaccgaggccatcgtgccgtgcatccgcagcacgccgtccgacatgatcgccacgtgtgagcagagccgctcgacgacctccagcacgtgactggagaagatcacggtgccgccaccggcgacgtaccgctgcaggatgtcgcggatcagcgcggccgcgaccgggtcgaccgcctcgaacggctcgtcgagcaccagcagccgcggcgcgtgcagcagggcgcaggcgaggccgatcttcttcttcatgccggccgagtagtcgaccaccagggtgcggttgtccaccccgaggtccagcacctcgagcaggtcacgggcgcgttgatcgaccacggcggccggcatgccgcgcagcaggccctggtaggcgagcaactcggggccgctgagccggtcgaacatccgggcgccgtcgggcagcacgccgaccagggctttggcctccgtgggcgcgctccatacgtcgtaccccagcagatgggcccggcccgcgtcgggccgtaacaggccgacggccatcgagagggtggtggtcttgccggccccgttggggccgagcagaccgtagaaggaaccggccggaacgtccagactgaccccggaaacggcgagtttggtgtcgaaacgccggatcaggccgcgcagcgacatcgccggcaccggcgactcgtccgggggtgctgccggcgtcgtcatgtctcagcaacgtagtcgcgcatccggcccgcgaccagcctgttcaccgcgggaggcgggcgatgtggccctccgggcagaacggtctgccggttcggccgatcgggagccgttccactatggaggaattgtcgctcaattagttcagttaattgacattcttgaccggctgtcacgatggtcacagcggcggtttctgacttgcccaaatgatccggagcggcgcaagattcggcgcggtcgtcgagatccacctatgcgaaaagggtagatctttgctgcgtcacggaaataatcggggcgcaattcgggcgccgaacggtcccgggtgttccgcgtcgaaacgggggaaacgcggaacacccggacccatcagccgacccgttcgatgaccgcgcggcgaatcaggaatttgcccgcctcgcgcacctgctcgaaagctgcgttgttgagcagcacgcagcttcccgaggtgctctggacggtcaccgtgatgctcttgttgttgtccaggttggtgaccttgagccgggtgccgatcgggaaggtgccgctggaggcgaacggggcgccggcctcgccggacagggtgaccgtggagcccttgcagacgacctcaccggcgccggtccctccggtcgccgccggcggcttcgcggcgggggcggtgctggccaccggcggcttcgcggtcggtgccgtggtggccctggtcggtttcgccggagccggctgggcgacctggccggtgcaccccgcctgacggcgctgcacgttgatcaggtcgaccaccgcctgacggttggccagcacggcgtcggtctgcgcgttcgggtgcgcctgctgatcggccatgaaggacaggttccgctgcagcgcctcatccaggccgtcacacgtggtggacgcgtgactcatcccggtgccgacggccaccgcgccaccggccaccacggcgagtacggcgccaagagcgatcttgcgggttcggggggatccgttcctacgaaatctcttcatgcccctgattacgagcgcgggttcatcggcggccggggaccgtaccttaaagatccttaattcatgatcgcagcgactcgggggcgtgcagccgcagcatcgtcgcaccgacatcggccggcacccggcggccggtcagcagcgacaccaccaccatcaccaggaaggccagcggcaccgtccaggcggccggctgcccgatgaactcggccagcccactcggcagatcggcgccgaacacggtgacgaagaccgccaccaccgccgcgccaccgccgatgaggatcccggcgatcgccccggcgtcggtcagccggcgccaccagatccccagcaccagcagcgggcagaaactcgacgcggccaccgcgaaggccagcccgaccacccgcgagacgtccatgtcggacacgaccgtcgccatcccgatcggcaccaccgcggccagcagcgtcgccagccggaagtcgcgcaccgagccggaccgcccgggccgcagcacatccgtgaagatcaccccggccacgctggtcagcagccccgacgaggtggacaggaaggcggccagcgccccggcggtgaccagggcacccagcagccggcccaggtgcccgccgcccagtgcggcctccggcagcagcagcaccacggcatcggtgtgcccggtcatcaacagctgcggggtgtagatccggccgagcacgccgtacaacgtcggcagaagatagaagagacccaccatcgccagtacgacgagggtggtccgccgcgccgacgccccgtccggattggtatagaaacgcaccagcacgtgcggcagccccatcgtgcccaggaacgtcgccaggatcagcgaatacgtgctgaacaggtgcgacccgccgggctgcagccagtccgcgccgaacttcgcgtcgaccgtgctcaccgccggcaccgcggcgccggccgcgaagtgcagcgtctgccccgccgtcaccgggccgatcccgtcgaccacggcgtcccgctcgatcgtcacgctgaccgcggccgggaagaccgccccggccggcggggtcaccgagggacgcccgtccgcctgccactggaagatcaggaagatgatcggcacggccagcgcggtgagcttcagccagtactggaaagcctgcacgaaggtgatcgcccgcatcccgccgaacgccacgttgccggtgaccaccaccccgatcaacagcgcaccccaggcgtacgacccgccggtcaccgtggcgaacgtcagccccgccccctgcagttgcggcagcaggtagagacagccgatgaacagcacgaacgcggtggccagccggcgcaaccgggtcgacgagagccgcacctcacagaagtccggcagggtgaacgcgcccgagcggcgcagcggggcggccacgaacagcagcagtgccagatagccggcggcgaacccgaccggataccagagcacctcgacgccgtaccgcaggaccaggccggccaccccgaggaaggaggcggccgacagatactccccgctgatcgcggcggcgttccaactcgggctgacactgcgcgaggcgaccaggaaatccgaggtggtgcgggcgaaacgcagaccgtacgcgccgatcgccacggtcatcaggacgaccacgaccaggcccgggaccaggtacggattcatcggccggggcgccggaccacggcggtgaagtcctgctcgttgcgttccgccccgtgcacgtacgccgcaccgacgagcaccaggaacgggaacgacaacacgccgaggaccagccacggcaggcgcatgccgaagacgtcgacccggccgaccgccggggcggccgcgaacagcagcggcagcgcgccgaggccggccaccaccaccagcgacagccgcagtgcgagcgccagctgggcccggaccaggccccggaccagggcctcaccgaccggcgtctgctgcgccaggtcggtgcgggaggggtcggcggcgcgcctggcgtcgcccagcaccacccgggtgcgcgggggcggcgattcgtcggccatgtccggcagtcttgccgcccccggcggaatgtcaataggcgccgcatcgatcatgagccatgggtggcagctgtccgatgatgtcccgggcggccgcccggccgtagttccactcgtaccaccggtcatccggcatggtcatcctgatccggtagagcacgcagacccgttgcggaccgtccacaccggtcagcgcgggcaccgcgtccggcgacagcccggacaggtaaccggcgtccacccggtccggcgaccggtgcatctggttgcgggcgatcatcaggtccgggttcgccgccgccagcccgatcagcgccagcacgccggccgcgatcgccgcccggggcagccacggcgcccgggtgcgcgtcccggccagcagcaccaacagcaggatcaccccgaaccacccctcacagcaggcgaccagcaggcggagccgggtcaggccgtacgtgtcgatgtacacctgcatccggaacagcgccgaagcgacgatgaccagggtgagcagcgtgagcgagccgagcacggcgcggaacacggcccggtcgccgggcgcctcccggggcgcccagcgggcggcgccggccagcaccagcagggtcagcccggtgacgatgcagagctgccagaagccaccccgggcatacgcggcgtaggtcaggccggccgtggtccgcacgtgccggtcgccgccgaacagcacggtcagctgcaccgcgacgaacgccgcgaagagcagggtgagcaggcccagcggcacggccgcctcgagccggccgaccctcatcccctcggtgtggtcgagatcggtaagccggggcggggcgatccacatgtaggcgacgccgctcagcagcggcgcggacagcccggccaggaagatccagcgcgccacgccgtccaggctcacctccgggagcaccgcgctgatcaccgacgcgaaggtggcgtcggccgaggcgaacagcagaccgaaaacgaccagcagcaggacggagaccgcggcggtcgcggcgatccggaacggcgcggcgccccgcggccggcgcacccgcgccagaccgcggaccagccagggcccggcccgcaacaccgcgaccggcccgagcgtgtacgtcgtgagcaccgcccgcatcgaccgaccggcgccgatcgccagggcgaaggtcagtgtcgcggtgcccacgcagagggcgaagagccagccggccgagcggaacgtgcccacgctcagcaggccgatcgtggcggcggcccacgggaggcgggcgccgagccgcggtgcgccggccgcgggcaccggtgggaaggccggcccggcggtcgggcgggcggtgagcaggacggccagccaggcgaccgcggtgatcagccagccgacgccggtgacgcccagcggcagggtgagcgcggtgaccgcgaccccggcgacgatcgccaggatggtgcccggagcagccggaccggcgggacccggcaggcggcggcggaacagccgagtgtccggccacggcccgtgaagcggaccttttgtcaggttttgtaccgtcggtagcgctgggggtgccgtggacatggcgttttctccttagagggggaggcgaacctggatctgggcgccgcgccggtcggccggctcgaccgcggcgatcgtcccgtcgtgcagttgcaccacccagcgggcgatggccaagcccagcccggtgccgccaccggccgggcgctcaccccgggtgaagcgttcgaaaacccgttcccgctcggccaccgggatgccgtcaccctcgtcggtgaccgccagcagcacctgcccgtcccggcgttcggcgcgcagcgtgaccaggccaccggccggactgtgccgggccgcgttgtccagcaggttggcgaatacctggtgcagccgtgcccggtcgccgggcagcaccagagccggggcggcgaccgagaaccggacatcctggccgatcccgtccgcgttcaccttcgcctcccggaccacctcgtcgaggaactccggaacgctgatcagctcgcggcgcagcgggaccacgccggcgtccagacgggacagatcgagcaggtcatcgaccagccggctgaggcgttcggtctgcgacagggcggtgcgcatggtttccgggtcggtggcggccaccccgtcgacgatgttctccagcaggccccgcagggcggtgatcggcgtacgcagctcgtgcgagacgttggcgatcagctcccgccgctgccggtcggcggcggccagatccgcggccatctggttgaaggcctgggccagctcgcccacctcgtcctgggagcgggtccggatccggtgcgtgtagtcaccgcgcgccatctgccgtgccgcgacggtcatctcgcgcagcggaatcgtcgctccgtgcgccatcacctgtagcgtgaccagccccagcgcggcggcgatcgcgatccagagcacgtcgacccggtagaagtcgatgctccacagaaagaccagcagcccgatcccgccggcgaaaccgagcgccagcgacagcttcgccttgatcgaccgcaccgggtccagcggccggggcagccaccggaacagccgggccgccacatcgtgcaccgcctgcatcagccgcgccctcaccgccccacccgccacatccccatcgccggcgccgccacccgcgatccgcacccggcgcgcgtgctcctcacccgatcggcgggccgtgatccgggtgcggcgggtgtgctgctcgcccggtccgtgggccgtgatcccggtgcggcgggtgtgctgctcgcccggtccgtgggccgtgatcccgatgcggcgcgcgtgctgctcgcccgatccgtggtgcgcgatccgcgtttggcaggcgtgctcatcgttcgatgtccagggcgtagccgaccccgtgcacggtgcggatcaggtcggcgcccagcttacggcgcaggcctttgatgtggctgtcgacggtccgcgtgccggacgcgtccgcccagccccagacctcggccagcagccgctcccggggcagcaccgtccgcggggtccgggcgaggtgcacgagcaggtcgaactcggtcggcgtcagatgcgcctcagccccgccgcgaagcacccgccgctccgcctggttgatctccaggtccccgagccgcagcgtcggcggcccggccggcgccgccacccgggccgctccggtcttgccgacccgccggagcagcgcatgcacccgggcggcgagttcgcgcatcgagaacggcttggccatgtagtcgtcggcccccaccgcgagcccgacgagcaggtcggtctcgtccccacgggcggtcagcatcagcaccggcaccggccgttcggcctggatccgccggcacacctccagtccgtcgaacccgggcagcatcacgtcgagcacgaccacatccggcgggacccgccgagccgcctccaccgcgctgggcccgtccccgaccacctgcaccagaaacccctcggcgcgcagccgcgcggccaccgcatccgcgatggcccgctcatcctcgacgaccagaacccgccgctccgtcatcgtctccacgccgactcccctccaccgaacaaattccccgcacccaccgccgacccaagccgggctgcggccgaagccgggccgcgacccaagccgggccgcgacccaagccgggccgcgacccaagccgggccgcgacccaagccgagccgcgacccaagccgagccgcgacccaagccgggctgcggccgaagccgcgccgtggccgaagccgcgccgcgaccgaagccgggctgcgagccaagccgggccgaagccgggcagcgacccaatccaacccgcggtcgaagccgcgccgtggccgaagccgggccgcgccccaagccgggccgcgatccgaagcgagcctgaaccgccctgcgtcgccgccggacccagggacgtcgcgccgtgaccggtgcgcccccgtgacccaccggcccgcgccgtgtgggcagcagcctattgaccgatcgcggaggcctggcgggggagttgtgaacgaactgtggagaagagccacagacagggatcaggaacggacagcccgccccctcagatccagccgtcacccacccgctgaccggccgacaccccgctgacctgtggataaccggcctcgaacggttccccggacgcttaagccgcgcttgcggttatcccccgccagcctgtggataactcagtggataagcctgtgaggctgtggataagcgtgtggattagcgcccccaatcatgcttggccgcccggatgagccggtctttcagctcccgggtgtgccgccggctgaccgggagctccaccccgccgaccgccaccacatagcccgaaccggtcagccgcagctcggtgaccagccgcagctgtaccaggaacgaccggtggatccgcacgaacccggcattcgcccatcgctcggccagcgtcgcgagcgacacccggaccaggtgcgaggcatccgcggtgtgcagccgcgcatagtcgccctgtgcctccacccaccggaccgacgatcgcggcagcatccgggtcgtcccggccagctcgaccgggatcgccgcctcgtcggccgggaccgccgtggccggcgccgcccgtagcccggccacccggcgcagcgactcgccgagccgttcggcccgcaccggtttccgcacgtagtcggtgacccccagatcgaacgcgtccaccgccccgtcgtcgtaggcggtgacgaagacgatcgccggcggatgcgcgaaccggcgcaggatgcgcgccagctccatgccgtccagcccgggcatccggatgtccaggaagaccgcgtcgacctcggtgtcgcgcagcacccgcaacgcctcggtcgcgtccccggcccggtgcacatgcgccacccggccgtccgcgttcagcaggtaggccagctcgtccagggccggcggctcgtcgtcgacggccagcacgacgaggctcatgcccgcacctgcggatggaatttcgggacccgcatgctcaccctcgtccccgcgccgggggcggtctcgacgaccagcccgtgatgatcgccgaacaccgaccgcaggcgctcgtccacattgaccaggccgacgtgctggccgtcctcgctgtccgcgctgtcctgcccgaagaccgtcggatccatcccgacgccgtcgtcctcgacggtgatgtggcactcggcgccggcgtcccgggcctcgatgctcaccataccgacgccgggtttgcgggacaggccgtgccggacggcgttctccaccagcggctgcaggcagaggaagggcaggccgaccggcagcacctcgggcgcgatctgcaaccgcacctgcagccggtcgccgaaccgggcgcgttcgatggtgagatagcggtcgatcgaacgcagctcctcggcgagggtggtgaactcgccgtgggcgcggaacgagtatcgcgtgaactcggcgaactccaggatcagctcgcgggcccgctccggatcggtgcggacgaacgaggcgatcgcggtgagcgcgttgtagatgaagtgtgggctgatctgcgcccgcagcgcgcgcacctcggcccgggccagccgctcccgggacgagtcgagctcggccagggccagctgcgagccggcccaccgggcggcctccagcgcggcctggctagctagctagcgtccggaccgggcaggggcgccaccacggcgccacggaccacgcagtcgacccggtcgcagggcagctcggcggcggtgagcacgatcgaacgccgggcgctcagggcgcgctgggcggccgcggtcagctgggcggtgtgatggccgccgcggccgtcgtgggccaggcagcgctcgtcgtcggcgatgctgagcccggccgcgccgatcagggtgcgcaggtggcgggccgccttggcggcggtggcgggggtcagcccggcccgcagcggctcggcggccagcgaggcggtgtgcagcacctcgtaggtcgcccgctgcatggtggtcgcgatgccgcgccgggcccgcagccggagcacggccaccaccgcggcggccagcgccgccagcacggcgacgaccgccagcacactcccgatctgcccagccacggctcagatcctgacgtctccgggccggtcgcgccatgcctgattccggacctgtggacaaccgggcaccggccggcggacgggcgacgagacgggccgccgcccacagtggacgacggcccggggccgggcgggtcagccggcgacggcgagcaggccgatcccgctggtgagcgacgattccgtccgggtggtcagcaccttgcgggcgggcgagagcagggtcagcgtccaggtcgagccggacctgctgcggaccagcacgttgccgtcggcccggaacaggatctgctccaccgcgcccttgaccgggagcgcgagcacccggccggtcgcccgcccgatcagggtgttggccagcgacgagccgaccgaccggtcgtactcgaagctgtcccaggtgttgacggccagcatgtcgccggtggcgtcggagctgatgatgtcgaccgcgcgcaggtgcctcgggttcttcttcaggctgcggtcgccgatgatcggcgtcttgacgatgtgggtgccgtccaggtcggcggaggcgaaggagacgccgtcggcgatgtacaggtagtgcttgccgtccggggtcatccggaagtgcaggccaccctgcagcgacttgggcagcgcggtgaaactcccgtcggcgatccgcacggtgccgtacacgatcggctggttcggcgcggcgttgcgggtggcgatcaggccggtgccgtcggcggtccagtcgatgctgtagttcatctcgttcaccggggcgccggcccggcggcggtcggtgccgtccacgttcgcgacccagaggcttcggtccttcgccgcgacccaggcgatcctgtggccgtccggggcgaccgccgtgttgccgtagtagacctcggagcccttcagcgcgaccttggcctggccgttgtgcacgtagagatagttctcgtgcttggggtcccagccgaagaagctgatgccgagccggggcgcgaccgccgcggccgccaccggggcgcttgccgcggcggtcggcacgacggccgtgtcgacggccgagcccggcacggtcgagaggctctgcgtccggctgcccccgtggcagccggacagcagggtggtgacgacggcggcggtcgcgatgatcaggtgggtcttggtgaggcgcatggcgtgctccggtttctttccgctcagtgactgacgcctgtgtagacgcgggtccgcgcgaatccgggtgacaccttcgccgaagttttgtccagaaaatcgaaatgacccgtgaccaggacggtcacgggccagtcgagcgacagatgtcagtaggcgcccttgcgcttgaggacgacgccgatggtgcgccagaggatgctcaggtcgtaggtcagcgaccagttgtcgacgtagtagaggtcgagccggaccgcctcgtcccaggagaggtccgagcggccggagacctgccacaggccggtgatgcccgggcggaccagcagccggcggcgtacgtcgccgaggtagtcgccgtcgtcggcgggcagcggccgcgggcccaccagcgacatctcgcccttgagcacgttgatcagctggggcagctcgtcgagcgaggtggcccgcagtttctgcccgaaggcgaagatccgcgggtcgtgcttcatcttgaagagcatgccgtcggactcgttgagctcttcgagggtggccttgcgctcctcggcgtcgacgtacatggtccggaatttccagaccttgaacgtctggccgtcgtgcccgacccgggtctgccggaagaagaccggaccggggtcggagagccggatgccgagcgcgatgatccccaggatcgggctgatcagcagcagcccgagggccgcggtgacccggtcgagcaggttcttgatcagccagccggggccggagagagtcggctcctcgacgtgcagcagcggcaggccctcgatcggacggatgtgcacccgggggccggcgatgtcggtgagctgcggcgcgaccaccaggtcgacgccggtgccctccagctgccaggccagccggcgcagctcgccgggctcggcgctggccgagccgcacaccgcgatggtgtccgcgccgacctcgcgcaccagcgagagcacgtcccgcccggtgtagaccgggatcggcgtctcgatgccacgggtcgcggcgtagccgtcggtgatgtggatggcgaccgggatcaggccggcggccgggctgcgggtgaccgcggtgtagacctcgagcgcctcgggcagcgtgccgaccaggatcatccggtgcgcgccgtgcccggtgcggcgccgggccaggtgcagcacctgccgggcgccgacccggccgatcaggatgaaggcgagcgcgctcagcgacaccgcggcgaccgtgccgcgggagagcgcggtcttggtggcgaacgcgagcagcgacacggcggccaccacggtgaccgaggtgcgcacgatccgcttgaactcctcgctgcccaggcccaggtaacggcggtcgtacgtgccgttggtccagagcaggagcagccagccgagcgggagcaccaggtacgcgaagaagttgaagagcgcgccgttggagaagaaccaccagctcttgtcctggaagccactctgcgatttctccagcagcgaggcgatccagctggcgccgagcgtggagatcaggtccagaacgatcaggaccgcggtgtagggccgatgccaccgggaaactcggcggtgctgacgggtccacgccgatcgggggacaccgttgctcggtggctgctgatcctgctgcggccactcgaagctgtcgtaccgcacgggcttactccggctgctgtcggtcgttgggcgatgcaggctagtcgtcacttcgcctacgtcctcccgcatccggaaaaagattacgcaccgccacgacctcggggccgtcggcgggtccgccgatacccgttcgcgtcacaacggtgtccagggaccgggccactataccgatggatcggcccgaaagaaggtgccgttggggtcccaatccttaccaatacggacggtgaccgatcagtggcggtgctcaccgcaccaacttggacaggcggcggtcggcgagcggtttgccgccggtctggcacgtcgcgcagtactgcaggctcttgtcggcgaacgagacctcgcgcacggtgtcgccgcaaaccgggcacggcaggccggtccgggcgtgcacccgcatgccggcccgtttctcgcccttgagctcggccgccttctgtccgacggatcgttgcacggcgtcggtctccacttcgcgcatcgcttcgtacaacgtggtgagctgctcctcggtgagcttcccggtcaacgcgaacggtgacatcttcgccacatgcaggatctcgtcggagtacgcattaccgatcccggcgagcacctcctgatcggtgagcacgcccttgacctggccgttgcgtgaccggatcagccgggcgaactcgtcgcgggtgaccgcgagcgcgtccgggccgagccgggacacccccggaacctcggtctgcgggtcgcggaccaggtaggccgcgagcgacttctgggtgccggcctcggtcaggtcgaagccggagccgtcgtcgagccgcagccggatcgcgatcggcccgctgcccggtttgagcggggccggcgacttgaacgtgtcgcggtagtgcagccagccggcccgggccaggtgcacgaccaggtgcacgtccaggccgatgccgatgtccaggaacttgccgtgccggccggccgaggtgatcggcaggccggtcagggcggagggcgccggatcgtacgtcttcagcgcgctgaacgaggcgacctcgaggcgctgcacggagtggccgaccgcacgctcccgcaggtaagcagcgagcgcctcgacctcggggagttcgggcaccccctcacggtagcgtttgcgaccgtgaaggtggtggttgcacacaaccggtatcgcgaggcgatcccctccggggagaacgtcatcgtcgacaccgagatcgagcagttgcgcgcggccggcgtggccgtggtgccgttccagcggagttccgactcgatctccgggatgccggccaggcagaaagcgctgctgccgatggccccgatgctgggcggggccgctcagcgcgatcttgccgcgctgatcgaatccgaaaaaccggacttgctccatctccataacccttacccgctcttatcgcccagagtgatccggaccgcgcacgcccacggcatcccggtcgtccagaccgtgcacaactaccgccaggtctgctcctcggggctgtatttccgggacggccacaactgccaggactgtcgcggcaagctgctgggctggccggcgatcagaaacaggtgctaccgcggatccgcggcgcagagcgcgatcatggcgaccacgctggccgtgcaccgtcccacctggcactcggtcgaccgctacatcgcgctgaccgacaagatcgccgcgcatctggacgactacggcgtcccggccgaccgcatcgtgatcaagccgaacggcctgcccgacccaggcgacccggccccgcccggcgacgggttcctctacgccgcccggctctccccggagaagggcctcggcctgctgctcgacgcctggcgacggcatccggacggctcactcggcccgctgcgcatcgccggtgacggcgaactgcgcccgctggccgagcgggccgccgccgagcgtgccgacgtcacctacctgggcccgctggatcgggccgggatgaccgcggcgcgcaccgccgcgtcggtcgtggtggccgttccgacctgggaggacgtgctgccgacggtgatcctggaggcgatggcggcggggcggccggtgctcggcacggcggtcggcggggtgccgtacctgatcggggaatccggttggctcgccgagccggacccggcggcgctggccgcggtgctgccgcgagcccgggccgaggccgccgggcgggcggtggcggcccgcgagcgctatctggtccacttccatccggatgtgctcacccggcgtttgatcgagatctacacgggcatgatttcggattcccagcgtatgtcgaggtagttcgcggccgatcggggaagactcgcgtctgtgatctcccgtcgtgctctcctcgccggctccgccgcggccgtcgccgccggtggagccggattcgccctcggccgcatcccggccgcaccggccgcccccgagcagaagaccccggtggcggccccgaagtatcgctcccggcccgatttgcaggccctgccggacgtcacgatcaccactccggcgaaccggacggtgcccggctacatcctgctcaccccggcctccgggcacgggctgtgggggccgctgatggtcgacgagaccgggtcgccggtgtggttccgcaaggtgcccgacccggccaccgtggcgatcgatctcaaggcccagatctatcgcgacaaaccggtgctgacctggtgggaggggaccatcgggggaaccggcgggcagggtgtcggccagggtgagttcgtcatcgccgatcagcagtaccgggagatcacccgggtccgggcggccggcaccgagcaggccgaccagcacgacttcgtgatcaccccgcgggacaccgcgctgttctgggtgtacgacccgatcgcctacgacctgtccccggtcggtggcccggccgacggggtgctgcacgacggggtgctccaggagatcgacatcgccaccggcaaacggctgttccagtggcgggccagcgaacacgtcacgctggccgagtcgtacgcgccgctgccgcagggtgatgcggcgcatctgccctacgactacctgcaccccaactcggtgggcctggacgcggacgggcatctgctgctctccgcccggcacacctggaccgtctacaaggtccacaagcagacgggcgcggtgctctggcgggccggcggcaagaagtccgatttcgcggtcgaggagcgggccgccttccactggcagcacgacttccgccggcgccgggacggcagctacagcgtcttcgacaacggggccgggatcaccaaggagcgcgattactcccgcggcctggtgttcaccgtggacgaggccgccaaaaagatcaacttcatggcggagtacgtgcacccggaccgggtgtcggcgccgacccagggcaacttccgggaactgggcgacggcggctcgttcatcgggtggggtcaggacccgcacttcaccgagcacaacgcggacgggtcggtgcggctggccgggcatctgccgctggacaaccagtcgtaccgggcgtacaaggcggagtggaccggcacgccgcacgatcaaccggcgctggggctgcgggtcgagggcggcaacgtgatcgtcaccgcgagctggaacgggcacaccggcatcgcccggtggcgggcccgggccggcggtcagccgcaggagctgagcaccacagtggaggcggcccggaccggtttcgagaccacgctgaccgtccagggcaccccggagtacgtggtggccgaggcgctggccgcgaacggcaccgtcctcgggtcgtcgtcagccatcccggtgcgcgtctaggtgcagcgcggtgcggccggtgaacgcgatgctggccgccagaaaaccgccgttgaccagcgtgaagactccgatgaaccagaccgtgagctggggcgccgcggccagcaccgccccggccacggcgatcaccgccccgtagtcgcggatcagcttcaccgcccgcaccggcaacgaccggctggtcaccatgctcgacgcctggccaccgccctgcatcaccgaggtcaccaggttgaccatccaggtcgccgcgaacgccgagagcagccacgccggggtgcccggctcctgcaccttggcggtcgccgcgagcgaggcgaccagggcggactgcaccgccacgtcacacagcacgtcgaggcgcccgccggccgaactgctgcgcccggtgacccgggcgagctgcccgtccgcacagtcgaacgcgtacgccagctgccaaccggccagcgccagcacgccgaccagccagccccacacccggccgtcggcgaccgcctcggcggcgctgatcaccacgaacgaggtgagcagcccgatgctgaggttgacgatggtcagcagggtggggctgaggtcgcggcggaaggcgaagaccgcgatccgggaaccgatccgctggctgaccgcctcgctgaacagcccgcccccacggttgaccgcgtagtagtcggccgcggtcggctgccggggctggcgggtttcaacgggatacaagtgcgtcttcatactcggccagcctttgacgtatctcgtccggcgtcagcgccagatgttcgagaatggtgtagcgatccggtcgggtccgcggagcgaagtcgatgacctggacgaactgctccacggtcagaccaacgtcgtacggtgatcggggaagttggtgacgggccaggcagtcagccatctgaccgaagcgccgccggtcgccccgcaggaacgtgcagaacagcgcgcccagtccggccagttcgccgtgcgacgcggtgcccgggtacaacgcgtcggccgcgtggatgatctcgtggcagccaccgctgcacggccggctgctgccacagaccgccatcgccagcccgctcgcgatcagcgcctcggcgagcaccgtgacgaacgcgtcgtcgttcaggtcgccgggcatggtcagcaccgcctcggcgcccatccgggccagcgacgcggcgatcccgtcgaccggctcgccgcgcacctgccggcccagctcccagtcggccagcgcgctgaggttgctgatcacgtcgccgatgccggcccggttcacccgctccgggccggtctcgacgaagtccaggtcgacgatcaccccgaacgggatgtgcaccccgtacgaccccttgatcccgtcgttgaccaggctggccaccggtgaggcgacaccgtcgttggccaggctggtggcgaccgagaccatcggcagcccccagcggctggcggcgtacttggcggtgtccacggtgcggccgccgccgattcccaccaccgcgtcgtagttgccggcgcgcagcttgccggccagctccagggcggcgtccagggtgccgccggcggtgacgtgcacggtcgccgaccgcagcgtgggccgcagcaggtcgacgatccgctcgccgaggccgggcccgacgacgatggcgacgtcgccgccggccgagatccgcccgtcggcgaggatccggccgaggtcggccaccgcgccccgccgcacctcgatgtgcagcggggtctgcacgctgcgggctagcagcggcatgcgatctcccgggccttgaccaggtcgtcgaggttgtccacctcgacccagtcgagcttgccgatctccgccgcgcggatctcgccgccccgctcggcgtactcctggaagccgtcctcgtagaaccggcccgggtcgcgcacccaggtcgcccgcagtgcgtcggccagcgccgccgcggcggaggcctcgatgatggtggcgccgatgtactcgccgtacgcctcggagggatccatcagtttggtgatcctcgtcagttggccgttcgggtcaaataccgtcttcatctcttcgtcagccaactccttaacggtgtcgacggcgagcaggatgctggggccgcgctcggcgagcaggatccgttccacctcgaccgggtgcacggtgtccccgttgatcaccagcgcgccccgcgcgaagtggtccctggccagccacaacgagtacgcgttgttccactcttcggcccggtcgttgtgcaccagggtgatggtcacgccgtaccgccgctcgaaggtctcgacccgctcctcgatcgtgtccgcgcggtaaccgaccacgatcgtcacctcgcgcagccccgccgcggacaggttgcgcagcgtgatgtcgaggatcgtggtgtcgccgtcgaccgggacgagagctttcggcagtgtgtcggtgtgcgggcgcagccgtcgcccggcgccggcggcgagcacaagtccgatcatgagaggtccccttcggcccagctggaattcgctacggggtggtcaacgagcgggggaggtaaagaaatgggacagacgctgcttctaagctggcaccatgaccgctgagcagctcatctcgttcgcccgtggcgctccgtcgctggacatcgtcgacgtggagggcctgaaggccgccgccgcccgcgccttcgacgccgacccggccggggtcaccgcgtacggcacgtccgtcggctacctcccgctgcgcaggtggatcgccgacaagcacggcgtctccccggaccaggtcatcgtgaccaacggttcgctgcaggccgacgcgttcctcttcggccacctggtgcagccgggcgacgacgtggtcgtggagaagcccacgtacgaccgcaccctgctgaacctgcagaacctgggcgccaaggtgcaccaggtgacgctgcggccggacggcatcgacgtcgacgagctgcgcgcgctgctggagtccggggtccgcccgaagctggcgcacatcatcccgaactaccagaacccggccggcctcacgctctccgaggagaagcggcgggcgctgctcgccctggccgagcagtacgagttcatcatcttcgaggacgacccgtacgtggacatccggttccgcggcgagccgctgccctcgatgctgtcgctggacaccaacaacctggtggtgcacgcctccagcttcaccaagacggtctgcccgggtgtccgggtgggttacctggtcggtccggccgcgctgatcgacgcgatcgcgaagaaggcgaccaacctgtacatctccccgggcatggtctccgaggcgatcgtgcaccagttctgcgtctccggcgacatcgagaagtcggtccgcaaggtcagcgaggcgttgggcgagcgggcccgggtgctggccgaggcgatccgcgaccggatcccgggcgccaccttcaccgagccggacggcggctacttcctctgggtggacctgccggccgacatcgatgtggagaagctgttcccggccgccatgaagaagggcgtcgcgatcgtcaagggcagcgacttcctgctggagggcggccgcaactcggtgcgcctggcgtactccgcggtcaccgtcgaccagatcgacgagggtgtccgccgcctggccgaggcgatcgacgaggtccggggccggtagaacggcggtttccacccggacggatcggggcactgacagtccgtccgggtgggccccgctgtccgaccccccgccgcccggcggcggcccgcccggccgtacctgctgccggcccgacgaagtagcctcagttggtttgtcggtgcaacccgggggaggtcggcatgagcgaacagaacggtgcgttcagtcgcaaccggccgttgtccaaggcctgggcggcccgggcgatgaatcggatcctcggcgccaacgagacgcatcggcatccggacgacgcggacgcccaggactccgcggtcgtcgactgcggtgtctatgtggccggtgagcggattcccggcctgttcaccccggacgaggcgttcgccgaggtccgccggcgtgacgacgcgttcgtctggctgggcctgcaccagccgtccgagcgcgagatgatcggcatcgcgcgcacctacggcctgcacgagctgagcgtcgaggacgcggtcaaggccgagcagcggcccaaactggaacagttcaacgacgtgcacttcctggtgctgcgcaccgcccggtacgtgccgcaccaggagctgaccgagagctctcaggtggtggagaccggccagatgatggtcttcgtgggcgaccggttcgtcatcaccgtgcggcacggcgaggcctccgagatgtcgccggtccgggccgacctggagaaacagcgggcgaacctgttgcagcagggtccatgggcggtcgcctacgcggtcaccgaccgggtggtcgaccactacctggaggtggccgagcaggtcgaggcggacctggacctgatcgaggagggtgtcttctcgcgcgaccgtagcgccccgatccagcaggtctaccagctgaagcgggaactggtggagttccgccgggcggtggtgccgctgcagcgcccgctggccgggatcatcgccagccagggcgtggtgcccaaggagatccggcggtacttccgggacgtgcaggaccacctcacgcgtaccgtcgagcaggtctcctcctacgacgacctgctcaactcgattctgcaggcccggctcgcgcagctctccgtcgaccagaacgacgacatgcgcaagatcgccgcctgggccggtatcgccaccgtgtggaccgcggcggccggcgtctacgggatgaacttcaaatacatgccggaaacccattggcggtacgggtatccggggctgatggcgctgctcgcggtgatcacggtgatcctctaccgggccttccggcgcaacggctggctctagactcccatccgtgggggatattcatcatcaccgactggtggacgcggtggccgggcacgacggcgatccgccccgccggcgatggctgcgcctgccggtcccgtcgctgctcaccggcgtgatgatcgccgcgctcacggccggtggcctggccgcctacgcgatgatcaccggccgctgctgacggcaacgccgaccggcccgctcccgggtcgggaacgggccggtcggcatcggctcacttggccgggccggtcttaccggtcttgtcaacgctcgccgccgtgccgttcgacgtggtgtacaccgtcggctccagcggctcgaacgccgcgtcgtcggcggcggccgtgctggtcaccgggttgggagcggcgtcgtactcctcccactgcgcctggttgcgacgcttggcgtaccacgcggcgccgaggcccacggcggtgcccagcagcgcgtacccggcgagcttgctgccccggccgctcttctcgcggccgagcgccttgtccgccttgcgctgcagcttgtcggcgcgcttgcgctgcgccttgagctcgcgcttggacaccttcttgccggtcctgcccgcctgccgcacgttgtcggcagcggccgcgaccaggggagtcagcgccgcgagagcactgtcccagctctgcgtcgcgacgtccttcgccttgtcggcggccggctgaacccgctcgaccgcggcgttgagccggggtccgaccgtcgcggtggtctcctgagcggcgatcgaagcggcgcgcttcaagtgatccacgctctgaccgagctcaccacgcatcttcgcgctccggcgcttgcggcgcatcgttgcgaacaccagtgcccacctcctgtggtttctccggacccatgttgccttctcgggtacccccgcgcggccggatcagacacatggggcaggatccgaactgacgagactgttcccatccgacacagacgggagtacccgtggccgagacgatttacgccaccctgcacaccaaccacggtccgatccggctccagctgttcccggaccacgctccggcgacggtccggaacttcgtggagttggccgacggcaccaaggcgtacaccgacccgcggaccggccagcccggcaacgggccgtactacgacggcaccatctcgcaccgggtgatcgccggtttcatgatccagctgggtgacccgaccggcaccggccgcggtggcccgggcttccagttcggtgacgagttccacccggagctctccttcgaccggccgtacctgctggccatggcaaacgccgggccgggcaccaacggctcgcagttcttcatcacggtggcgccgaccccgcacctgaaccgccggcacaccatcttcggccaggtcgcggacgagcagtcggccaaggtcgtcgactcgatcgcgaacaccccgaccggcccgggcgaccggccgcgcgaggacgtcgtggtggagcgggtggagatcgagcgcgcctgagcactcacggtacctttggtgccatgagtgaggctccttccacgtcgccggtgtgctatcggcacccttcgcgggagaccgtgctccgatgcagccggtgcgagaaaccgatctgcacctcgtgcatgaacgaggcgacggtcggccatcagtgccccgactgcgtcaaagagggacgtcgtggtcagcggcgcgcgctcaccgccttcggcggtgacgcggccgctggtcgcgccggttacgccgtgaccggcctggtggtggtcaactgcctggtgatggtcctgtcggtggctttcggcgggctcaagtcgatcgccggctcgggcggtttcatgggtctgggcggctccggcacccgggtcaccgacgccctcgaggtgatcggcctggcggtctatccggacggcgcgtggcacggtgtcgcgcacggcgagtggtatcggttgttcaccgcgatgttcgtccactacggcgtcgtgcacctgctgctcaacatgatggtgctgctgcagctcggccgctatctggaggcccggctgggcccgatccgcttcctggcgctctacctgctcgccggcttcggcggcaacgtggcgtgttacctgctgaccccgcagaatcagccttccggcggcgcctcgaccgccgtcttcgggctgatcatcggcatcatcatcgtgaaccggaagctcgccctggacgtccggtcactgataccgctgctggtcgtcaacgtgatcttcacgttctccatcgcggggatctccaaagagggacacctgggcggtctcctggtcggcgcgctggccaccatcgccctggtctatccggcgccgccgcaccggacggtgaaacaggcgatcggatggtcggtgatcttcctggcgctggtggtcctcgccgtctggcgcaccacgcagctcacctagacccggagatccgacaacgtcagcagtacgtcttcgggaagcgcgcccagctcctgcgcgctgaacagatagatcgcgtcgcccgcgtcgatctccagcagctcgctgcgcaggccgcggcggaccgtccggtcgacgcgcagccgctccacctccgaccagcgcagatgccgccggcgggcgaacccggtgaccaccgtgaccccgtcgctgtcggccgcgagccggaccgggaccagcacgtcgcgcagcgcccacccgaccagcccgcagccgatcagcgcggcgagcgtccagcggaccggatcccgcccggcgaacgcgacggccagcgccaccacggcgaccgcaccgaccagtttgaggaccggcaggaccggccggacgcgccattgcatggggacactatggcaccacgatcgctgtaattccttattcaccagctcgggccgctgcctccggcgttcacacagcgttaaacatgtcatggacgtgatctcgtgtacgttcctccccgccaccgtcgaagccggcgtggccatccccagccggcacctcccgatcgtggagcgttgcgtcgaggccgacgacagcgcggtcctggtcacccactgcacccggccggaggcgccgctcgccggtgaccatctgctgctgctcacccggcgccgcctggtggtgatccagaagacgccggtgctgcaccgcctgcgcctgcacctgaacgccaacctgcggcacctgagcaacgtgacctggcgccccgacctgacccggccggcgctggagatggccgccaccgcggtggacggggtacgcgagcggttccggatcaagttcgcgaacaccgaggcggtgtggcgcttcgagggcgtcctgcgcgacgtcttcctagcctaggaacgcttcctggcctagaaacgcttcctggcctagaaacgccgtgatcgacgtccgcagcccggccgcgtcgaggccgtgctcccgggcgtggtcctgccacgttccgtaatcacggatctcggcccgccccgcgcccaggtgcagggcccggtgcgggatcccgctcagcgcctcgctgaccagccgcgcggacgtgccggccaggtagggctcgaccaccaccacctcgccctcggccagcgaccgcaggccctccacgtccagcgggcgaggtgtgttggtgtacgccaccgtgacgtccagatcccgggtcgccgccagcaccgggtcgagcatcggtccgaccgccagcaccagcggcccgccccgcttgaccacccgcagccgcccggcgtccgggtgggcgcgggcgttctcctgcagtcccagccggatgtagacccggtcgtcgtgccgggccgccgcgcgcagcatcgccggcacctcgtcgcgatgccccggcacctgcacggtccagccgtccagggtgtcgagcagcgccacgtcaccgggggactggtgggtgtatccggcggccgccgcgtcgtacgacccgccgatgctgaccagcaccgccccggtgtcctggtgcccgagatccagcttgatctgctcgtaggcccggtcgatcaggaacggcgcgtacgagtgcaggtacggccgcatgccggtgagcgccagcccgccgcccaccccgaccatcagctgttcccggataccgacgttgagcgcccggtccgggtgccggcgcagcgcgggcgcgaacgcgtcggcggagatgtcggcgagcaccagcgcggtccgcggatcctcgtccagcagcgcggtggtggtggccacgaaggtgtcccgcatgacgttcagctccccttggcctcgaggctggcgacgaccaggtgcggccgcccggatcggacccgcaggccctgttcgatctcgtcgtggtcgtgcccgtcgaccagcgagacgctccagcccggaaagcgggccggaatgccaccgggccagccgtgcgtggcggaccggttgtcgatcacgatcgcggtgagcggcaggtgcacggccgcggcgtacgcgatcgcctcatgattcgatccctcgtcgagctcggcgtcgccgagcagcacatacgtccgggtctcggagaagccctgtgcgcgcagcccgagcgcggtgcccacggccaggcccagcccgtgcccgagggacccggtgccgatctcgaccccggggatcagcacccggtcggggtgggtgccgagccggctgtgccactgccccatccggtccagccactcctgcggaatgaagccgcggtcggccagcaccgcgtagtaggcggccggcccgtgccccttggagagcaggaaccggtcacggtccggcgcgtcggcggtctccggggtgatccgcaggatccgctcgtagagcacccggatcacatccagtgtggagtgtgcgctgggcgcgtgtttctcgtcaccggtgaggcgacgcagcgtcgtgacggtcatgtcggataggctgcaacttgaagttcacttcaactcaaggggatggttgtggagaccctcaccatcggcgacatggccgcccgaagcggggtggccccgtccgcgctgcgctactacgagcgggaggggctgctgcacgccgcccgcaccggcggcaaccagcggcggtacgaacgcgccgacctgcgccggatcgccttcatcaagatcgctcagcaggtcggggtgtcgctggaggagatccgcgaggcgctcgccgagctgccggagaaccggacacccaccagggcggactggtcccggctgtccagccgctggcggcaccgcctcgacgagcggatcgcgatgatggaacggttgcgcgaccagctcaccggctgcatcggctgcggctgcctgtccctgcaacgctgcagcctgatcaacccgcgcgaccggctggccagccgcggcaccggcccgcagatgatattgaacccgccggccgcggaagtgtccgaggatcggtgaaccaccggggaggtcaggcacggcagcgccccgccgcccaccgcggcggggcggccggaagcggccgcgctcccgtgtctcagctttgcgtcttctccacgtagtaggcgtacgcgaagctaccggcgagggatccggtgacctcggcggagaagctgaccgggccgtgcttcgccggcgcgatactctgctgagccaccgatccgtcacaggaatgcgcctgcgccggttgtttccgtgcgccaccggcgtcgaccgtgaagctcactgctccacccccggtgcagctgagggcgaaaacgacgctcagcatgttctccggcgtatcggcgagcgtattactgatcggtgaccagaggaccccgtatccgctgccgagctgctccatgccgacccgcagcccggcgcccgcggacgtgggcgcgacgatgctggcggctgtacgccccgggagtctttaaagaaactttaaggaacgcttgctcagcgtcatgaactgctgccacagcactgctcgtatatctcggcacaggcagtaccgaaccgaagaggagccgtgcatgtatcgacgcggagtcagcagtcggacgcgcaagctggtgattggagccgccgccacagcgctgctcggctcggcgctcgcgatcggcacggggatgagccaggccgccgtccaacccggagccggctccggtggcatcaacgctctggtgccggcgctgggtttcggcccgggcgatccgaacgcgacggctgaccgcgtgggccccaccggggtgaaggttcccggccgttgcccgcccactcaagcccaggtgaacgcccaggtggcgctcaggaatgcgagctttccgagtggaacggacctcgaaagccgcatccaacgttttgagaagaccctgtcggcgattcaagacttgaaatgcccggcatcttccacgactttgctgggccgcttgaagtccctgaccgcgctgcgcgggaacccggaccgcgacaacattctgcgtggtctgggtctgaacgaaacgccagcggacaaagccaccgccacgggatccggtgacgcggccgcgagtggagcgacggggaacgccggagccggctccggtggcatcaacgctctggtgccggcgctgggtttcggcccgggcgatccgaacgcgacggctgaccgcgtgggccccaccggggtgaacgttcccggccgttgcccgcccactcaagcccaggtgaacgcccaggtggcgctcaagaatgcgagctttccgagtggaacggacctcgaaagccgcatccaacgttttgagaagaccctgtcggcgattcaagacttgaaatgcccggcatcttccacgactttgctgggccgcttgaagtccctgaccgcgctgcgcgcaaaccccgaccgcgacaacattctgcgtggtctgggtctgaacgaaacgccagcggacaaagccgcggggaatgcggcgccgcaaaacgcgccagcgaaataggcggctcgcggacaacggcagcccgatcctttgcagagcctgatccaccgcacggaaccgcctcgccggaggccctcgaaccaagggggtctccggcgcgtccgtgtgctgcctgtagccgtttgatcatgcgagctcgtcctccggctcgaaattccaccgaagcactcggccactctcggcgtcaccctgtcgcgccgcggcgcaccgtctgaagacattcgtcgggcgctccactcgtacgtgtccggcacgacacggcgcaccgcggggcagctgcctgacgacctcgcctcggccgtgccgcagtgcgcacaccgtcgagctccgccacttgacggacgctgcggtgatccgcgaggcgctcgatatgccggcgccgtacacaatggatgctgcgcagtgggtgacgccgaagtccgaccgtgacaagccctcgcgctgctctccgcggcggccgccgcaccgcacctcgtggcgttcctcgtctgcctctacttcgcctacttcgccggcctgcggcccgccgaggcggtgcacctgcgtgccaccgactgcgttcggctgcgcaccggtcggctgtctgctcgtcaccccgcgctcgtacggacgaggcccgctgtcccgagagacctgctcccggacccggcgcgcagcgcgcacggcggccctctcgccagcgcaccggtcgacgctggccgcacggccatgtgacctgcgacacgcgggcgtgtcactgcggctcaatgcgggcgtgccggcaacacgggtcgcgagtggggccgggcacagcgtgaacgtgcctttggggtccacgcaacgtgcctttcggggcaggatcgtcgaggatgcctcggaactggacgatgaccagggcgaacgctgaggttccacggccgcgcacctgccgtgacgggtgagatgcggcggggtccggtgagactgggcggcgatccacgacaaccgccgctgacctcagtttccccaggtcagcggcggtttccctgctcatcgaggcggaggacgtgggattcgaacccacgatgggttgccccataccggttttcaagaccggcgccatcggccactaggcgagtcctccccgtgctgccgctccagtctgccagacgccgcacagccgccgtcgtttgtgtcgtacctgtggggcagagtcggggtatgcgagcgatcgtcatcaaagacaggcaactgcattgggccgaggttccggatccggagccgggcgacggcgaggtggtcgtcgacgtcaccgcggccgcggtcaaccgggctgacctgctgcagcgtcagggcaactatccgccgccgccgggtgcgccggcctatccggggctggagtgctcgggggtgatcagtgcgctcggcccgggtgtcgagggacaccatgtcggggagcgggtctgcgccctgctggccggcgggggctacgccgagcgggtggccgtgccggccggtcagctgctgccggtgccggccgggctgtcactcgtcgaggcggcggcgctgcccgaggtcgcctgcacggtctggtccaacgtggtggcgcacgatcggctgcgcgccggcgaggccttcctggtgcacggcggcggcagcgggatcggcacgttcgcggtgcagctcggcaaggcgctcggcgcgaccgtcctggtcaccgcgaggtccgcgaaacacgagcggctgcgcgcgctcggcgccgaccatctcatcgactaccaggagcacgatttcgtacgagaggtgcacaccgccaccgggggccgcggggcggacgtgatcctggacatcatcggcgcgaagtacctggcccgcaacatccaggcgctggccgtcaacgggcggatctcggtgatcggcttccagggcggcacccgggccgagctcgacctgggtgccctgatggccaagcgcggcaccgtctcctccacctcgctgcgggcccggccgatcgccgacaaggcgcggatcgtggccggcgtccgcgaccaggtgtggccgctggtcgcggccggtctgatcaaaccgatcatcgacaccacggtgccgctcgccgaggcggccgaggcgcagcggctcatggaggccagcgaccacctgggcaagatcctcctggtccgctgaccccgcgtcgcgtcggctgccgcggcgccgcaccgcggcagcggcccggctcgccacatcgcctgttcccgcatgtgttgtcgggcccggctccgtcactcgatcggaggagtatctctgtcgtggtctgaccgataaagttccttttgcggcgagtcgcggcgatccgcggccgcggccaacccagcatggacggacagcgcgtccggccctcgggtgcgccccggatccgctcgctgggggacaccgtgacctacacaccacaccggccgccgaccgtccgggtgaccgaccccgacgacgacggtgtggacgagtgggcgctgcgctggcgcacccggatctgggtcggcggcggcctgctcgtcaccctggccctaatcaccttcggcatctgggcggtggcgaccgccgaccaaccggcgggcgggccggcggtgttccgtgggctgcccccggccggcccggccgacgcgtcccgcggcggcttcggtctgcgggtcaccagcgtgcgctgcggcgtctccgcgatcggcccggacgggctggaacaacgcgcgcacgggcagttctgtctgctcgacgtacgggtcaccaacaacggcaccgagccggcgttgttcgacagctcggcacaacgtgtctacgacgccgacggtgcagcatacgccgttgccgccgacgccgcggtttttctcaacgatgacagcccgacactgctcgacgagatccccccgggaacgtcggtggacggcgtcctgcccttcgacgtcccgaagaacgcccagctcagcgaggtgtccctgctcggctccggcgtcgcgccgggcatccggatgtcgctgcccgctcccgagtgaccgttcgcctttatcttttcgagatcgagggattaattatctgaatccagccacgccgtaattcaaggtgtgttggcatggtccacggaatacacaaagttgtccgggttcccattgccctccttcaacggcggcaaaagtgcggcgagcaggttcacccgtgctgatgatgggattcgcgtgagtgccccgggcctatttcggaggcaacactgcacggaacgtccgcccgccgtgtgctgaccgccggcgctctcgcgctggccgtcatcgcaccggccgtagaccctgccgagcacgccacggaggccgcaccggcccccacggccctgccggcgaacccggagtcaccggccttcgcgggtggcttcgccgcccgggacagccggatcctctccgacgacctcgacgagagcctgttcatgcggcgccaggccgccacggcccgggcgacccgggccatgcagcgccgggcggtcaccatccgcccggcgccactcgccccgctgcgcgcccgaccgggcgccccgtctcccggcgccgccccgaccgggcggtccgccgccgggcagcgcctcgcgcgatccgcttccgggcagcgtgccggtcaggggcagcggtccgcctccggtcagcgcggcaccgtcgagaagcggcccgcgttcgggcggcactcggcggagaacgcgctgcagcgggcggtccgtgccgcgcagcaccggacggtcgcccagcggcgcaccacggtctcgcaccgcggcatggtgcgccggaccacgcaccggacggtctcccggaccctgcgggtgtccggcggcaccgggcggatggccgcggtcatcgcgtacgccaaggcccagctgggcagccggtatgtgaccggcggcgagggccggggcggtttcgactgctcggggctgacccggcaggcgtacgcccgggccgggatgcggctgccgcactcgtcccgcgcccaggccgcccgggcccgcagcgtcgcccggggccaggcacgtcccggtgacctggtcgtcggctccggtcacgtcggcatctacatgggccgcggcatgatgatcgacgcgggcaaccaccgtaccggcgtcgtctaccgcaggatgtaccgcggcctgcgcgtcgaacggatccccggagcctgagacggcagcagccggcacccgccgtgtcagggacgggtgccggctcgcatggcgtgccgcacacaccgatcgcaaccgagcgcggggatctttgccgcacgcacccggtcggatgtctgacagaagcatcgccgaccgtcgcggtaccggtgcgcaccacctgtgcgtttacccggacgggtgaccggtggccgcaacagtccggcaagccgtctgacacttccggcggttactctcggctcatcgtgggaaagccagatcagttaagtaaccacgccggaggaccccaatgagtcttgaccgagctctggcccccgatccgtacgatcttctaccgcaggtcccgtcgttcacggtgaccagcgcggacgtgacggacgggcagccgctcgacgagttgcacgcgcacaccagcgtcggcgggaagaatctctcgccccagctgtcctggtcgggctttcccgacgagacccggggtttcgtcgtcacctgcttcgacccggacgcacccaccggcagcggtttctggcactgggtgctggtcaacctgccgctctcggtgacctccctggaccgcggcgccgacccgttcccggacggcgccttctgcgtccgcaacgactacggcgagcgcaactacggtggctcggccccgccgcccggcgaccgcccgcaccgttacgtcttcgcggtgcacgccatcgacgtcgactcgctcgacgtcaccccggacgccacgccggcctacgtcggcttcaatctggccttccacaccctggcccgggccaccatccgaccgaccttcgaggtccgcggctgaccgacccgtcaccggcggcgctgcgtctccccgcgcagcggccgcccgcccggcgtcactgagtgttcccgggcggcgccttgtccggcgtcggtgcgtcttcgcgggcggtgcccgcttcatccggtgtcggtgcgtcttcgcatgcggtgttcgcttcatccggcgtcggtgcgtcctcgcaagccgcgcccgcttcatccggtatcgctgcgtcggctcgtgcgatgcccaccagccgctcacccgggcttcggttggccggaaagcgaagaggcgccggccctcgggccgacgcctctactgcttggtgcgtgtggtcagcgcgggacgcggccgaccactgcctggtgcgtgtggtcagcgcgggacgcggccgacgcagaagaccgactggccgaacggcgggcggacgatccgctcggcggccttggtgaccgggagtacgagcgagtcgtacaccttcaccatcgggccctccttcggcgccagcttgaagatgctggtggcgccgtagtagccgatcaggcccagggcgttcgcgtagtggatcttctcgatctcgaggccggcctcggtgtaggcggcgcccagggtcttcttcgtgtaccggcggatgtgcccggtggcgatgtcgacctggctcatcgcgaacatgaacgccggcacgatgatgatcacgtggccgccggggcggacgagttcacgcatgctgcgcagcgcgccgacgtggtcctcgatgtgctcgagcacgttgtacgagacggcggcgctgtactccccggcggcgtcctgcgccgggagcagcatctgccgcacctcgatgttcgcgtgcccggccatccgctccttgagctggaccagccggtcggggtcggcctccgtcgcggtgaagcgcggaaggtgctcggcccactccaaggcgtagtccccgaggccgctgccgatctcgatggggttgtccccaaggtatgggagagcgagctcgacgaaccaccgacggtggttcacggccgttgcgaggccttcgagcacttcggactggatccgctggtctccagtgatgtctgccataggtgaggttccctcatcttgccgatctgtgctgacagcaggaccggtgaagttaaccatctgtcgccgctatccgaaagttgaccgccggggcacggcgattttttggcctgattgagacataggcgccgcgggtagtccgttgggttccgcgtcacacctcgccgcctctggcgttgatccatggacacgcggaaaacacgcgtacatatcgtctctatcacgctgcggccgctcatcgtggaactcttccccacctcggttaggctcgccgatgctatgacgattacgggttttgactcgacgggccagacggccggtgagaacgttctgccgccccgccagttgaccgcagccgaggacctggacgccgagctgctggcactgggtggcggcctcatcaccgccgcgccgacctcccccgcgcccgccggggaaaacaccgctgagcaggctgaagcgcctgttcgccgccgtcctctgtggcgggtgccgacctggcgcgacgtggtggcgatagccagtttcctggccgtcgcgctcttcgtcaccgccccgttgtggctcaatcttgatcatgagttgcgcgatgatccgcaggatcaggctttcttcgagtggatgctggcgcacggtgcccgcgtgctcacggatggcgtatatccgttcttctcggatcgcatgaattaccccgatggggtgaacatgatggccaacacctcggcgttggccgtttcgttgccactgacgccggtcactcttctgttcgggccgcatgtggcgttcaacgtatttctcaccggcgcattggcattaaccggtacctcatggtatttggtgctctcccgccgcctggtcggctcgcggctggcggcctgggtgggcgcgctgttcgccacgttcgcgccgagcatgatcgcgcacgccaacggccacccgaacatcgtctcgcagttcctggtcccggtgatcatctggcggacgctggagctgcgcgtcccgggccgggcggtccgcaacggcctgctgctcgccggcatgctgatctggcaggccttcatcaacctcgagatcctcttcatgaccgcggtcggcgtcggcgtcttctgtctggtcatggggctggtccgggtccgccggcaccgcagcgagccgttcgccttcctgcgcgggctgatcgtggccggctcggtcaccctggcggtgctcgcctacccgttgagcgtgcagttcgccggcccccagtcgtacaagggcctgtccgaatacgtgcgcagtttcggctccgatctggcgtccttcaccgcctattcgacgcactcggtggccgggaatctcgaggttccgctgaccctggcgcagaacccgtccgagcagaacgcgttcttcggctggggactggtcatcctcttcttcggcctggtgctctggctccggcgcagcgccgccgcactcacgctcggcggcctcgggctgctcttcgcggcgatctcgctcggaccgaacatccggctcaacggggcggacaccggcgtaccgggaatctggtcgtttctgcatcaccttccggtgttcgactcggccgtcccgacccgcttcgcgatggcgatcgcgccgatcgtcggcatcgtcctggcgctcggctgccagcgtgccgcggaactggtccgcacccagccgcagacccgcggcccgatccgggtcgcgatgatcaccgcggtcgcgatggctctggtcccgctcatcccgcaccagctcgacacggtgaagatggagacggttccgtccttcgtgacctccggccagtggcggcactacgtcgacgacaaccacaccgtcgtcaccctgccgctgccggacagctactaccccgacccgctgcgctggagcgcgtacaccaagctcgacatgcggatcgccggcgcgtacgcgctgttgccgaaccagaacccgcaggacccgaccgaccacaccgcggcgttcgccccgccgtggcggcccaccagcggcctgatgtcctcgatccggcagggcaacccgacccccgaggtctccccggcccgccgcgagatgaccctggccgacctccgctactggaaagccggcgtcgtggtcctcaccccgcagacccgcgacatcgagatgctccgcaccatgtccgacctgctgggcttccgcccgacctggaccggcggcgtctggctgtgggacgtccgcaacctggtcgacaaccccgacgcggtcatcaccgcggacgccaccagctgaccgacccctccgcccccggccctcaaatccgtggtcggggggcgagacctgccgaccggtccgccgacgacatcagttcccggggccggttgcgtcgtgcggtgaatagccaacccggcaatcccgccggctctgccgtctcctccggccggccaccgtcctgccctgccgacgatcgcggcgccggcttgccgcggcttccaggctgagcgcggcgggagcttcacgacgtaccgccgagccgtcgatcgcgacgcgcagcggtcgcaagtcaaccgcgagccttgcggaggccacttccgttggccggatgaacccggcatccatcggccggtaagtcgaccgcggaccttgcagaggctgattctctggccggctgcacccggcatcggacggtccgcaagtcgatgacgacccttgcggaagccgcttcctctggttgaccccacccgtcatcccgtggctcgcaagtcgacggcggatccggaaagccccgcgtcgggagtcggccgcggatcctggagcgacgcggccgcgaatcgctcgccgatcttgctcgcccggctcccggcggatccggaatcaggcggatcgagggaatgccggattacagatgcacgcggccgtaatccgataaaccgcaaacagccgccgtcacggcttgatgcagcaccccgggcacagcttcggcttcggcagtgtgaaagccaggcagcaagtcttgcgctgcacctcaagccgcccgttcgccccgggcgcgaggtcgatcaggtcccggatcccgagcaccccgaggagtttctcgatcgactccgccgaggagcccggcaccgtgtcggccgatcgcaggaccccgtaggcgatgccggaggcgagcgacccgagcagcggccgtttccccagacggacccgctggtggatggcgtcgagcagcggcgtcaggtgctcgtcgagcaccgcccggcggaactcggcgagcagggcggtctcgtcgggcacgaccaccgcgtcggggtgtccgctgagagccagcgggtcggtgggcagcacggcgaccgggatgccggcccgtagacccagcgtgatcatcacggtcgggttgtcgtgattcgtcaggacgttaccggcggtgatcagcgggacgcgacgggccgaggcccatccgaggacggcgggcagcaccgcccagtaggtgtacgccttccaggcgagggccgcggcggcgtgtggctgcgcgttccaccggcggccggcggaggcgagcagcgggctgagaccggggccggcgaggtgggtggcgggcgtccatccggcctgctcggagacgatcaggccgggagcgagcgagggcacctgcaccccgccgaacatgccggcgagggtggcgctgacgggcgcgagcgggcgggagccgacacgttccagggtgacggtcacgcgctcaccaacttctcccacttcaccggaccgagagtactcggctaagggtagcctcaccaacccctagcagggaccattcggtcgaatacccagcgcaatggttacctaacgtagcgtgttggacctgccggttttgtcaagatacctgtcggcaacgtgcctctagccccgttcggacgcccgatgccggtgacactgagggtgccgtcgcgaaggggacatccgtgatgaccacctcgcccgtcgagcgggccgcagaccaattcgtctcggcgcttgcgcaatggcgggtggagcgcgggatgaccaagaagcagctcgccgcgcgcatgggcttcgatccctcctacgtcagccacgtcgagggccgccggcacaaaccgaccgaggacttcgcccgccgggccgaggcggtgctcggcgcgggcggcgcgatctggcagcgcttccaggagtacgacgagcttcgccacgcccgcaccccgggcccgcaccgcgactcgccggtgcggtcccagtggctgccgcccggcgccggcctggtggtcgagcgggagatcgccgagctggcctacaccgacggcgcgtaccggtgccgggtgctccgctcgctctacaacgccggcgtcgaaccggtcacccggtacctggtcaagatggccgtcgaccggtatccgaacgatccgaccggctccaaccgccaccaccgggagaacccgctcaccttcgaggaactggacgtccacgcggtcgccggcgagggtgacgccgccgagccgatgcggtggcgggtcaagctcgaccgggacgccgccaaggagatctggctgctgttcgccaacgagcgcggccagttcccgctctacccgggcgagcgcaccacgatccagtacgcgtacacggtcggcgaggagaagtggggccagtggttccagcgggcggtccgcctgccgacccgctcgctcaccgtccgcctgaatcttccggaacgcttcgaaccccaggtctggggcgtcgaggtgtccctgaacgcggaggtcccggtccggaccccgctggaacgccgcaacgagggaggtcgcgccattttcgagtggtccactgaccagcctttgttgaacgcccggtaccgcctcgagtggcggttccgtggcgccgacgcccccgtccacgacgatctggccccggccgagccggtgctgccccgcgcctcacaccggatgcgcgggatcgggatcatccagcgcggctccgacctgctccggcagcgggcccgtcacttccagctcccgcgcgaggcgccggccgcccgggagacggtcacccggctgctcacctcgctggcgcagctggaggatctgcacgagttcagcaagggggtgggtctggccgccccgcagatcggcctgccggtggcggccgccgtggtccgcgcgccggaccgggagatcgagccggtggtgctgctcaacccgcgggtggtcggcgagtcggcggcccgcgacgagcagtacgaggggtgcctgtccttcttcgactaccgcggcctggtcgtccggccgctgcggatcgaggtggaacacgcccgcttcgacggcgcccgggtggtgaccgtcttcgagcgggcgctggcccggctggtcggccacgagatcgaccacctggagggccggctctacgtcgaccggatgaagagcgacgcgaaactcgtcccggtcgcgcagtaccagcagaccggccgcccctgggactactgatcagtcgctgaacgcgtcgtacttgatccggatcgacgggacctgcagctcggccagcgtccgcagggtcgccttgaccatcgggccggagccggagacgaagaagtcgtgctcgttccacgggccgtaccgggcgaccacatccgagatgttgccgttctcgccggggaaggtcgggtcgtcgctgcacgcggtcaccaccgacagccaggggtaacgggcggcgagccgattcaggtcggccaggtcgtacaggtcctcgcgggtccgcgcgccgaagaagacgtgcacccagcgggtccggttgtaccgggtcagctcctccagcagcgacttgatcggggccagcccggtgcccccggccacgaacacggcgtcccgggtcgatcttcgatccagggtcatcgagcccatcggcgcggccagtttgatcatgtcgcccaccttcagcttgcggaccagagcgctggacacccagccggcgccgagcgcccgcacatggaactccagcgtgttgtcccggcgcggcgcgttcgccggcgagtacgtacgccacagccgcggctggtacgggctcgcctccacgctcaggtactgcccggcgcgatactccagcggctgcatcggcagcaccgtgaagaccgcgatgtcgtgcgaccggcgctcgtgctgcaccacctcgccgtaccagtacggcggattctgatcagactccgcgccggccagcatcttggcggcgatcaccgcgtacgcgtcggcccacgcctggtcgtactcgaccccccactgctcgccggcgaacgcccgcatcgactcgatcaacgcgccacccaccacctcgtagtgctcgggcagcacgtggaacttccggtggtcgcgccccagcgaccgcaggtagtcctcgaaccgctcggggtcctccagggtctgcaccgcggtcacgatcgcgtgcagcagccgggtgcgctgcacgtccatctgcaccgggaagaggtcccgcagatccgggtaggacaggaacatccgggcgtagaaatagccggccaccttgtcctgatgctcctcgacgaggctccagctctccttgagcaagcgtgcgaggtctcccatgcattcagggtggtcagcacagtcgggaacacgacgtacgcagagtgcgactcgtcacgtgccgcttgtctatatgaccgattttgtgccctcgtagagtgggcgcgtgactctagaaggccagcggtccacccgatcggcgtaccccgccgagatcgccatcgtcctgctgctgtcgctcgggcagtcggcgatctggtcgatcgtgtcgctgaccgccaagctcaccgacggcaaaccgctggccagccacaccgcgacactcaacgcgccgatgtcgccccgtccctacctggacctcacgtaccaggtgctgaacatcttcttcgacctggtaccggtggctttggcgtggtatctcctgcgccgcgacggcatccggcccggccgagacctcggcatcgacttccggcgcccgggattcgatgcgggctggggcgccggcctggccgccggcatcggcctccccgggttgttgctggtgtacgcggcgatcaagctcggggtgtcggcgcagatcgtgccgtcggcgttgcagccctactggtgggcggtgccggtgctcgtgctgtcggcggtgcagaacgcggtgctcgaagaggtgctggtggtggggtatctgacgacccggctgcggcagctggaggtgtcgaccgggtggatcgtcgcggggtcggcggtgctgcgggggtcgtaccacctgtaccaaggctttggcggattcgtcggaaatatcgtgatgggggtgattttcgcgttcttttatctgcgtaccaagcgggtgatgccgttgatcgtggcccacagcatcctcgacatcaccgccttcgtcggctatgacctgcttccggactcctggctcacctggctccacccgtagccgttcgttccgggcgccgcgatttccgggccggcccgggctcgtcgtttcccggtgctgccacttcgggcccgcccggggtggtctccggctccgccacttccggctccgcccggggttcgccatctccggctccgcccggggttcgccatctccggccccgtccgggtcgtcgtttccggggcttcgccgcgaggctgctactcctgcgacctgcggctcgcgtaccacccgtaccgccgctccgcgcggaccgccaccgcctcggccgtgttccgcccgccgagcaccgcgccgagcatgctcgcccccgggaaggcccgatcggccagccgcagcgccgcccacgccgcaccgccccgatagctgggcagcagcaccaccagctccgccgcacgctccggatccgtcggatcgaccccatacgccgcggcgacatgcaacaccaggtccgcgtgcgtcaacgcggccgaggcgacaagagcgatcggcgcgtacgtcccggacagcgcgctgaggatcccccgccgctccgccgcgcggacagactgcgccgtcgccagtcgtgccagcccctgcggtgtagccgccggataagcggcccgggtccgagccgcccacgccgccgcgcgcggccccagggtctgcaccgccgcctcagccagaatccgcgctgcgtcccgcggctccgctaccagccgaggccacagatccaccacgatctgatccgccaccgcccagtgcaaccgctccgcggcgttgcccaccaccggcgtcctgctcgcaccgaccgcgtacacctttgccgtgcccggtgtcgcggcgtctgtgacccgatccgcctctgccgtgcccggtgtcgcggcgtctgtgacctggtccgcctctgccgtgcccggtgtcgcggcgtctgtgacctggtccgcctctgccgtgcccggtgtcgcggcgtctgtgacccgatccgcctctgccgtgcccggcgtcgtggtggccgcggcctggtcggtctccgttgtggccggtgccggtgcggtcatggccggtgccgtggcggtcgccggctggtccgcttccgccgtggtcggggtccggtccgctttcaccgcttccggtgctccactcgctggcatcttgctcgccggcggcttgcccgcggctgctttccggggccgcgccacccgcttgaccgtctcggcagccgccgggtcaccggtcgccgcctgatcattcgcagcgggcaccgccttcgccgccgcccgggaccgcggcgccaccttcttgaccggcgccttccgcgcagcgcccgtcccgtccgcagcccgctccggctgcccgtcggccgctccggccgccccgttgtccaccggcgccacggtgcgcgcggccctggaagtcctggcggcccgccccgcggctttggctgccggccgcggcggttcgctgtcctccggcgtaccggaagaagccccggaagggtgaccttcagcactgaccccaggccgaggcggctggaaagtaacggccggcggcgccccgcgccgcccccgccccccaccggcctgctccgcctccggcgcactgaagggcgcccgcggatccctggcacgcggcgtctgcttctcctccatcctgcgcagcgtagtcgcaaccgcaacgtttcgcctgttcgcagccttcgtggcagatcttcgggaggtttcgggccgacctctttgtgcgacgctcaacgggtccggtattctcagtcctcggtgactctcgcaggtcaccgaggagacttcgcctagtctggtctatggcgccgcactgctaatgcggttggggttttaaagcccctcccgggttcgaatcccggagtctccgcgcaaaagtcggtgtgtatgctgactgagcaccaagagaagcgcccgtagctcaatggatagagcatctgactacggatcagaaggttaggggttcgagtcccttcgggcgcacaaaagatcaaggccgtgacctgcggaaacaagggtcacggccttttttcttcccattttcagccccgaaagtcccgcatggtgggaccgtggtgatccggtggtgatcgcgtgtcaaagactgttgatccgcggtgggtcagtgccttgtgctggcctttagcggtgcgcaacgcgccgcgtgcaagcacgaaagactacagagagtacatcgatgacttcgaggtcccgctgttcgctggggctgtttgtcactcggtaaggcgatagtgtgccccgggcgcctggtgatgcgccgggcttgcgcgtcgtgctcatcgactagttggaatcactggtgtggaggctagctgcggaaatctgtgccgcatctggctgttgctcgggcctggattcggagaaaccggttgctgcgggccggcgcgacggtggcttttcggatgctcgttgcggatccggcggagtaccgtgaccaagaccttggccgagcaagatcagtgttgatgcagcggggaccgtctttcatgttctctgatcatcgttcgtcgacggatgccgtgtcgatgacgggtatgcatccaccggcacggttctgggccgtcgaccttcatgtgcacacgccggggtcggcagatgttgatccgctgacgtatggggcttccgcggctgaagaggtcgtggcggcggcactctccgccgggctggacgccatcgctgtcaccgatcacaacacagtgcggtggtgcgatctggtggctgcggccgctaccgcgacgtctttgatcgtgctacctggcatcgagatcagtacgaccgaaggccatctgctggcggtgtgggatgaagggacaccgctgcatctcatggaggacgttctggtcgagctggggatacctcgtgtagaccagggaaggctggacgttgcaacccgcggcggcttcgctgaggctgccgaagcggtccatcgcagtggtgggatcgccatcgccgcgcacgccgaccgtcctaaaggtctccttcagttgacggtcgccgcgaacgtcagcaagatcatcctcaacccggccctggcgggggtggagatcgttgatccagaggcggccgagcgggtttcgtcgaagactgccggccgacgggagatggcctgtgttcggggctcggacgtgaccattcccggtgggaatgtgcacgtgttggagggcatcggtcggcggcggacgtgggtgaaggcttcccggccggatctttgtggtctcaagcatgccctcgctgacccggagctgagggtccgactggaggagccggcagagccggagcacatgatcatcgagtctgtccgggtctcgggcggttttctcgatgggcagacgttcgagctgtctgcagacctcaactgcctactggggggcacgggaaccggcaagtcactgttgatcgaggtgatccggtttgcgctggaccagcagaccgatagttccgactttccccaggtccgccgggaagtggactcacgtctcgatcatgcgttgagccagaacgcatcggtggaggtggtgctgcgccgcaagtgggcacggtgcgttgtgcgacgcgcctacttcggcgatcagtcaccgtcgccggagatgtccggcgacacggagcacttcgtgaacccctcgggtcgagttgccatccgggccttctcgcagagcgaggtcatcgaacatgcacgcacccgggtcgggcgtatgacgctgattgactcgggccttgatctggaagacctcgttgccgctgacctcgaagtccgcagccggttggcggacaacagccgcttgattgtggggctgcgtgacggcatccgcgaggcggaactcctgttggagcagcgtcccgttgtcgtcgagcgcttgaccgagctggggaagttgttcaacggcgatatcgtccggcaacaggccgcctggagccgagagcgtacgtggttcaactccctgacatctgccgatgcgctcgtggcgccacatatcccccaggtgatgtcgttcgtgcacgcggttgcggtcgaggccaaccgggacctgtacgaccgggcggccacggcgctgagtgcactggaggcgacgctcaagtccgttgatgagaaacttcagcaggcctacgcggcggcaggccgggagctggccggcatcgtcgcggaatggcgtgagcggcaacaagagttcgacgccaagctgcgggcggtcgtggcggaggctgacgtcgagggcaagggcctggagacgctccggacgcgcttgaccgagctgcaaacgaacaaggtcacgctcgatgatgttgcgacgaagctggagacgacgcttcgtcccgggttgcgtacggcgatggaacaccgcgaaaccatcattgaggaactggtggtgttgcggaaagagcgccgcaagcgccgcgagacccggatcaggctcttgaacaagctgatgtcgggcgtggtgcggataaagctggacagtgaaagtgaggacgaagactacggagcgcagatcgcggcactcgcgaaaggatctcgtcttcgtgcggacgtcttgcagcagctgtgcgcgaagtcgcaccccgtcaagctcattcgctcctttctggacgatgacgcagagggcgtcagcaaggtgaccggcgttgagagccgtcacatccagaccttgttcgagcatgtcatcgagcggcatcaggaggaagaattcctcggcctgcaatcgcttgagctgctcgacgggctctcggtggagttccgcaagcggggcgaaggggagtacgagcacatcgaacggctcgcgcacggccagaaatgcactgccatcctgatcatcgcgttggcggatggtgctgaaccgttgatcatcgatcagccagaggatgcgctgcatgctccctggatcgaggagtatctcgttgagcggctccgtggactgcgtggcagccgtcagtatgtgtttgccacccgtagtccaggcctggttgcgtcagccgacgcggaaatgatcatcacgctgacgtctggggccacgcaggggaccattgaggcgagcggatcgctggagcgctacgaccttaaccgccacgctctctaccaccttgaaggcgggccgcagccgttccggcggcggacgacgaagctcgggccatcgatgtccgccgtcgtttcctaaacgcgaggggaaggtaaacgcacctccgagcccatcgaagttgatcatctgccggagtcggaacccaagggtcaccgtcagcgcatgccacccggtccggctttcgagcgccgcgcccctctcgctgaggagaggggcggttggcgtagccggtgagaacccagggtctggtggacgacgttgctagtttcctttgctgacgacggcgaacagcagcagcatgagcaggaagccgaaccagaagttccagattgaattgagccggtagtagcccttgacgggtttgccctggcgggtatgcggcttgacgatcggcatagtcgagggactccttacgcctgggttgcagcgccgatgaggaacaagacgaacagcaacatggctaggtagcccagccagtcccagtccgagttgctcgaggccggtgtgagggtcggggcggcgttgcgcaggtggggccggacgtacgttccgtcgtcgcggcggtggccgcgtacgcgaatcattccggcgctgcggacggccctgggggtgcttcgtcggtagtgcggacggacccaccggccgttgcggtagtgcccggagacgtgcggcatgatctactctccgtgatcaagtagtgataggcgacgatgcatgatggcatggccgtacgacatttctgacgccacacgctttgatctcatagtgcaaagctgctgatcaagcgtttgaagtgcgccggagctgttcacgttgaccgatgggaggctcagatcggcacaccggcgtgctccagccacatgatcactccatgtattctttcggcgctgtcccgactgtgccgcggcaggcagtctccggaccaggtgaacgttcgcggcttgcctcccgctgcgactactgcaagtcatgcctgacgaggagtccgctgtgcacaaccgggatccggctttatcgaatgaagcaccctggtgcgcctaccccggtgaatcacggccggcggcgtaccgcggcatcgtggtcaggtgtcttgccgtgccgagcaggctgggcatgctgcggctggcgcggcgcgagatcggcgacgatgacgcgccatagccatcgttgctcgcgctgtatcggcggccgactcgtgaagtcttcggcgagccgccgtcctagtcggcgacgaggacgccacgtagcgggagttggactgccgatcctgcgggaactcggtgacgaacagaggtgtcatggcgtcactgaacgacgtgattgcggtagttcgtcaagcggcgcagcgcacgttgaagccttcttccgaattcgtcctccgaggccgagtcgactcagacggccccagaggtgagggctggtaccgcctccgtgcccggctcaatcctggcgatcttgaccggatggatggcgcatgcctggcgccacaggaaggtcccgagcagcgaagcttcgccgtgatcgacagcgaagtcgtggacggcgtccttcgggtacggacccagtccggcgcaccggctcagggattgtcgttctgggttccagcgatggatcttcgcgcctcgcgtacggcagtgcttgagggtctgagcgcgctcgcaccggacaatctcgtccaccgcttcgatcagcagcgactggatccgttaccgccggccgggccatgcgacccccggctcaacgacgcccagcaacgcgcttccgacgcctgctgcgctcccggattgcaggttgtgtggggcccgccgggcaccgggaaaactcatgtcatcgtcaacgccatcgaacgcctgatgacggcgggaaagcgagtgctactcgtatcgaacaccaacgtggcggtcgacaatgccgtcgagggcatcatcaaacgccttgcccccaccgccggccgagtgatccgggtcggtactccccgcatcactacggtagcccgtgacgagcgagtctcgctaaaccggctggtcgaagctcgccaacgcaccgccttggcgcgcctaagccgtctggaggacactatcgcggagctgcagagcaatcatccgcagcgccggctcgccgattcggaggctgcactggcgggtttcgaccctagcgagcatcgacgccgccaggcgcggcgggacaatcagcaccgagcgcagcagctgaccgcccaggtacaggcagcggccctgcatgccgctgaggcgaagggtaacctcaagcaagcgactgccgacgaactcttggcgcatctgctcgtcgccatggtctacgagcgcatagctcgacacgaccgggatcaggcagcgcaggggttggctgaggaggaacgcagcaccggattgtcgcgggcgatgtccacgatgcgccgccgacaggcccgcggtgccgcccaccgcgccgagcgcgaactggacgcaaagcggacggagcggaccgctgcggaagcccggttacggcaggccggcgcggaggtgtcccatgccctttacgtccaagcgcaggcagccaccattgcccaagcccacgagtgggccgcgcatgccgagctgcaccaaagcacagcggtccgggtaaaagaagccgcagccgaagccctggccgcggttcggcagcgactgagcatcgccgctgcggcagcacagccctccgagcaggatctgcaactgctccgcgaggcggaaatgcgcggtctgccgcagctgcatgaagagctgtccgcattgcggcaatccgctgtcgagtgcgaccgaaagatccgcgagtgccaaacacagcacgaccgcctcgtgaccgacctggcagacaagcggcccggtatgcaagccgcgctcattgccgaggccgccgtcattgcgacgacgctcagcatgctgacgctcaagaagatgatcctcagcacggcgttcgacatggtcatcgtcgacgaggccgcagcagccagcttgcccgaactcatgttcgcggtgaaagctgctcgtaccggcgcgacgctgctcggggactacctgcaaaacggacccttcgtcgatccgagcctgcccaaagaagatctgatcaaggccgtctacaccagagactgcttcgagatattcggactgactgatcccgcaaccgcgtcccagcaacccggctgcgtggttctgaccgagcaatggcgcttcggatgggaactgaccgagctagccaaccgggtggcctacggcggactgctgaccgccaaaaacccgaagacctgcgagatcgtgctcgtcgacaccgacggcctcggcaaagccctcagtggcatacgccgggcgcgtcccgacgctgtcgccgggacgtggccgatcggcgcgctcatcgctcgagctctcgccgagtaccaccacccccgtgatgggtccgtcggcatcgtgaccccttacaaggagcaggcagaaacgacgcaggaactgctcgccgaatccgcgtgcggcccagcgatcgaagtcggcacagcacacacctttcaaggccgcgagtgcgacatcgtcgtgttcgacatggtcgaggacggcaggggatgggtcgccaaaggcgctcacggctccgacgcatggaagttgcaagggctacggttgttcaacgtcgcgacgacccgggcccggcaacgcctctacctcatcggtgacggcgcagcaataaggcgccgcggcagcggccctcttggcgcactgcgacacatgattgacgccggcacgatccaacgtgtcctcgccagcgacctcctcggcatcgacgaggccaacgcgccagtcgaggaaaccgttcaccacgacctgtggagtgcgctccagccgtacatacggcttgtcggaatgtacgacgagaagcagatcatcgccgaggtccagcagcgcgtcgacagcgccgcgtcgtcggtatggatgtggagcccctgggtcggtaagcactccttgggtctgcaggacagcctggtcgccgctcacgcccgtcaggtcgaggtccgcgtcatggccttgccagagaaagagatcaacgctgaggtgcgggcaacactgaacgccctacgagcgcggctgccccacgtcgttctggtgcacaagatgcaccagaagattgtcgtcgtggacctgcggtggactttcgtcggcagcatgaacatcctctcgcaccctcgtcgaccggcagagggccgccacgaagtgatgatccagatcgacagcgcccgcttcgcccgccagatcctgtccttcgagctggccgaccagatgcgtaacccaccacgctgcgagacctgcggcaacaccatgaccgaggccaaagaagctgggaggtcacccgatcggcgttggctctggtactgcggtcgaatgatcaacggtgaaccgtgcccgcagacactggagttccctgaacgcaccggccgaaatcgcgccggttcagccccactcaagcgcaacagcacctcgtgatatccgacaacgcagaccggcaatgacgggcgagacagcaatgacggcacctcaaccagaagcctcacagatgaacaccgatctgctgcactctggcggcgatggctcggccgcgcccgacgcgctactacaccgtcagctgtgctggatcgctttggtaacagaccataggaatgcatgactactttgagattagcgttgactgagggcaggcggggaaacgcggtcatgcgcactgtcgacgaatcggcgtcgagcccgctgcggagcggtataggcatcatctatcttgctatatgagacgccgcgttggacgatcgaagataggtatgattctggcaaagcgggcagtggtgagcttgatgttcacgcgcctgagctcttctgattagggcgctgtctacggaccagaaggttaggggttcgagtcccttcgggcgcacaagtaatcaaggccgtgacctgcggaaacaagggtcacggcctttttgtttcccattttctgctttcaaaatcccgcccggtgggaccgtggtgatcctgtggtgatcgcgtgtcgaaggactgtcgattcgcgctatcccaccggtcgtgagctgcactttggcgccgcgaatgtagcccctgcgatcgaacctcaccgttatggttctggtgtaggcgaggcgatgatctccccgcccatctcgaagaccgctgcgatcggcatctcgcggcgcggcatgccttcctcggccaggtcgatcgcggcgtcggcgaggtcttccggcgtcatgccggctccacccggccggcgcgcggctgcgggatagcggcccgcgacgctggcaccgcgtcagcgggcacggctagctgtaggtccccgccggggcagtcgatgctcgtgttggggaccagtcggggaatgaagctgtcggcggtggggcggccggcctgctgccagaggattagccactcgcgtaggaccgttagcgacgccgagtccggtgtgtcggcgatgatcgtgccgtcggtcaggatcacggctgcggatgtggcggtggtgtggccgatcccgcggatctgattgcgcagcgacaccatgctcagaccggggtcgggcggggcggcggtgtgggcgctccaggaccgccagtcggcctccatgtcgccgtaggtttcggtgtgcccggggttgaggagccggtcgagggccgcgcgggcgccgctgttgtgtggatcttcggtgcgccagctgatggctatccaggacggatccggttggcggtcgcagtagtcgacccaccggccgggcacggtcacggcgtcgtccacgggcgccggggtgctctgggcgtaaaccccaccgacgacggcctgcactcggggctgcccggcgtcgacagtgatggtggtgatcaaggcggtggacggtagcggtgcgattggcagggaggcgacgatccggccgccatccgtgatctgctcgacccaggtccggggaagccgcggcggagtgcaccacccgaccgcccgatcgaacggcgcggcggtggggaagccggccaggccgtcggcgacgtgacagtcgatctcggtgactccgcgttcggcgtggatcgcgcgcgcccggttgatgagttcctcgctgatgtcgatgctcgtgactcgcccgcgtggtccgcacaggcgggcgagcagggcgccgctgtaaccggagccggtgccgatttccagaacgcgatgcccggcctgcacccgtagggatgtcacttcacgctgaatccactcaggcacggagcggtggacggtcggaccgtagcgctcgtgatcggtataggcgagaacgggcacggcaccgaaagcctcattgaggtcggtcacggatcctcccaggttgcacggttgaggcgacggatctgcggcggcgcggtcggtgcgaccggggaatgcccgctgtagcagaacagcaggcgcggggtagcgcagtcggcggatagatcatgtgtcgatcagggtgcggctcggtcgaagcgaacggcggtcccggctacaggatccggcggagggcttactgaggcgctcacggacgctccgcgcattcgttcacgggatcggccgggacggtttcctgtccacttgtgtagcccgcagactggagggcgaagagctcggcgtggctgcgcgaatacccccagcacgcccgccgccgcccgtcggcgcatcccgtgttcctaccacgcgttccgtagctccggcagcaccggctccagcggggtggaagcctcctgattcgtgccatccggggatggctgttcaggtagccgtgctccatcggatttggtggtgtggatgtccacgtctggtcctttcactcgccgatgagctagttcgcaccttggcgcgctgccgcgaaccgctgcgttcgggcggttgtccgcagaaaagccggccatagccggacaccagccgactgtgcacggtgaacccggccccgcaggcgccggaggcctacccgcctgcagaccggtttcccgccaccagtgtcgaattccagggaacgcctccccggcgtttcagcgtctgcgacgggacgctcctccaggtgcccgtctctacggcaacggcactcacctgttcgtgtccctcctgccggatggtctgcgttgtcagagcccggaggaacgacgacaagttgtggagccctccccatatcggtactcgcccgccctgccggggggctgtctcggacacgacgaagtccgccgatgcgggtacggcaatcgcacagatggacgaccgctgcgtgtcgctgagcgttcacaccccatgacctcatcgctgtggccagccgaaacggcgacatcgctctcaccacgaaaaaggggcgtacgcgcaaggcgggacggcgggcatgacgaagcggttcccggccatcgtggcggctggcagtaacgcggtcgtgaaccgcaacggcacgggcgggcatccgcgacgagacacacagccgttgtgcgtgtccgggcttgacgtacgcggtaggttcgccgggtcctgtcgtcgtcggccggtgaagccgcggagcggtatgaatgcgctgcgccggaggacgcaatggatccgactgcctgggaggcgttgcatgccgatcgctgatgcggagatcgccgccgccgttgccgcctacctcgaccggtatcccgcggagaaggcgttgctggccgagccgatcgagctcctcgcccggggcagcaactttgcctctcgacgcaatttcgacttgcacgtgaccgtcggcgcgttgctgacccgcggcggcgaggaaatcttgctggtcgggcatcgcgcgtacgggattccgctgcagccgggtggccatctggagccgagtgacacgactctgatgggtgcggcagtacgcgagctggcagaggagaccggtatcgatccgaccacggtcactaccgcgtccgcgacgcccgtgtatgtggagttcggtcgggtccccgctcgaccgcagaaggacgagccggaacatttccacctcgacctgggatatgccttcaccaccacaggcgacgtgggcagcctccaggagtcggaagtgacgagcgcggcctggtaccggctggacgaggccgaacgcctggtcggctcccgcgtctggcgagcctgcaacccctcggtccgcatcggctgaccgggagcagccgtcggtaaccgctggatccacgaccgcggggtagcctggcggtgtggtccggcgggcccgggcgaagtgcaccaggtgaccgcgctgcttgctgcatatgccggcagcgatgttctgggaacggtccggccgggtcactcgaacgacgctttacgggtccgcgtttgtttgagctcgaagaacccgtccgtgccggcgatcagcaccaggccgtcccacagccggcccgcagcctcgccgcgcggcgccggcgtaatgaccggcccgaacagagccgtgcccttgatccgtatcacgggcgtgccgacgtcgagcccgacctcgtcaaacgcctgatgatgcgactgcttgatctgctggtcgaactgtgtactcgtcgccccggcggccagcgagaccggcagtccaacctcggccagggcttcggtaggaccgtgggatcgtcgcggagctgccgaagccctcggtgagctgccggccgaccgtgaggcctacgatgcgggcggcgccgtgggcgcagcaccttcgcggtactcaccagggaggcccccgaggtccaggtgtcgtcgaccagcaggatcgccgatcccggcagccgggtggaggcgttaaaccgaaaataggaggaatccacgacaccacgcgccggacgctcctcccttggtcttcgacatcaggttgaagatccatggcacgggccagtcgctgatgaggctggcggcggtcgggagcgggtcgaaggggcggtcgcccccagctcgggacgtgggtctggaagtcgaaggggccgaagcgggtttcgaggcagcgcaggtgccgcacgagaaggtcacgggtcagcgcggccaggggcgcggccagccatcggtgatccgggccgaagtctttgtagcggtgcagcagggactccagtccgtccgacgccgtaagggtttggtcggccgtctctcgcgctgggtgagacaccatcgccggccggcgacgacgtcgagacagctgactgggctgccgaggttccggctgagcgagcaggacgaacaggtggctgagagtgagcaaggtgccatgtgtcctgaaacgcgatgcgcggtggtcacccgctcggggcatgcgagcgcctaccgtcacgaccttcgcggctctcggtactccgtgggagctgtggtcagtagcctctggcggggttttcgttgccggcgggcttgtagcagggtgtgaccacgatgatcgctatgccggtccgcggcacggttgattggacggagatcgtcaggccggattccggtaccaatgccgaggtgcttccaccggtgtcgccgtcgggcagcaggtggaactcggtgatctggtatccgcggctggtccagtcgtcacggatcttgttgagggtggcgacctggtcgtcccgggccacttcgacgttgccgcccgtgctgaggtcccatcggccgtcggaggcgacgaccccgtcggtgttctcacaggcagccgaactcgttcgccatccggtgagcggtttcccgacgagggatgcgacctgctcggcgagcttcttggccaggttctcggcgtcggtgcgtttcatgacctgcatctgctgatcctttttggcggcgggtgtgtctgcgggattggcgggaccgctgtcgcaggcggtcagcgcgaccaccgcaccgagcagcagcggggccaggatcaggcggcgtgtcatgagggaaactttccgtatcgagggatcaggttgccgtagtcgccgacgacgacggatgcctggctcttgaggctctgtgacccggcctgccagtaggaggtgtgccctggtgtatcggtcatgaagacccgcgcaccgaattctggcagatgcggttcgacgccgtgcttcaacctgatcgcggcctgtacgccgtcgccggccaccggaatgccggtctccaacggaatggcggtgtccgggctggcaaccatatcgtcgggggcggcgccggcccagacgtggtctgcgccgacgctcaggtccgaggcccggtgcacgtccatgcccgggctgcccaccacgacaacgtcatccacggccagccggtggccgccactggtggcgtcgccgactaccaccgatccgtaggagtggccgatcgcggtcatgtgcaccggcccggcatcgtggctcacccttagcccgtcggtgaacgcgagcaggttggtggcgccctcctgcgcccggtcggagccggctgcggtgacgatggagtcgtcgagctgcggagggtcgtactggagccaggcgatgaccgagacgtcgctcgcgccgagcagttcggctgcgtcgcggatgtggtcggcccggccgatctggtcaaccatcccgtcgaggttgttggtcactccaggaatgagcatggcggtgtgccgggcggtgtcggggttaccgatggccacggcggcccgtccggtgccctggttgtcgatggacagcaggtagagcggtttgccggtctggtagtcggcggcgtcgagccggttcatcaggttgaccaggcgttgatgctgtggatcgttcgggtcgacgcgctggttcacgccttgcccgatcagttcgtgcagggctagccggttcgcggtgtcgcggtcggttgccggcagaccgttgaggcggccgacctcggcggggtaggccatcgatagcagttcgcgctggtcggcggtgaggccgtgccaccaggcggcggcctgggccgggttggtgccggcggcggtaatgtcgtctgccgtgagtccgttcagcccggcaagctcgcgagcggcgtcggtggtgtgctgccagctgaactcgttcgggccttggacgtcggggccgaagtcgcgcagcatgccggcgtaggtgagatcgatgtggtcggcatctttgaggatcgaggcgatcacctcggtgtagacgtcggcgttctggttcgcgagccggttgacctccagcgcgccaggatccgacagggcggattgcggcacctcatcggcctggacgcgaccgtccgcggtcaccgtcaacccgagcgaggtagccgcgtcgatcgcggactggagccgctgctgcaagccctggaagtccgtggcgattcgctccaacagcatgccgatgctgcgggccttcatccggtacaggctgaactcgtcttccagggacgtcatccggcgcagcgcttcggtagccgccgcaccttcccaggccccgttctgcaacggcttggacaactccagctcagtccggtcttcaagcttgctgcacttgccggcgagctgacgccagacgtcggccgcgaccgtaagccggtcaacgcgcgcgtcgcgtagatccgcgaaggtcaccaccggtcagcgcccccggatgtcgaacagatcggcactggcgtgatcggtgtgctcatacgtcagcgcagcccgctgcagcgcgtcgccgaaggtttcgagatagccggtgagcttcttgacgtcgtcctgccagtaccagacgaaatctcccagcgcccgcccggtcatccagcccggcaacccggcggcggcgtcctcggtaaccggttcgacaccgtgttcatcgcgtctccacgcgactcccaagtcctcgcacacctgccgcgcagaatgcagcacggcgggctcgacatgcagttcgtcgcccacgctacctcccccgtattgagcaggatgaacatagcgaacgccgacaaccgaaatccggcgaggtcagggcaagatcagcactatcaggcccgaaaccaccaaatcggaagccggagctggcggcctcgacgcctctctcgtatcaagaaaccctaaccagccgcaaacggttcatgatccttttccctcgaggcggcggcagagcaaccgtccggcggttccggatgtcatcgtcacccggcacccttggggccgggaggctacggcgatggcaggtaagtaccacccgttgaccgcatcgcggtagtgcccgcgagcggtacacacgcggcaagggtccgccgcagagcggacgtaccgagatcggcaggaaccctcggtctgcggcagatatcagcgaagcgggggtgatcagcggcggcgtgatacttcgccgcgagccggatcagatagagatcattgaccggatcattcgggtcggcgccggcggggtcgtcggcgggatgcccggccaaggcctcggtcaggcccaacggcgcgggagagctcgccgcactgaacgagcgccctcccgccgactgggcaggacggcggttgttgccggccccaggtacaggtcgaccagcacgggtaactccgccaactccagacaagcagcgacgtaggcgcctcccgccggagcgtttacgcggcttgcgcggcgtgtagagcagcgtgccgggcagccgtagccggcgaaagggttcacacgcagttcggctgacacagagtgttcacggtgacgaccagatcgacgttgggcttgacccgtttcgacggacagggtcgatgagttgatcttcaggctaccttgagggcgggtagcaggctgatggcggcaccgccctcgtaggcggcagggctgcggtagccgagactggaatgccgacgccgggtgttgtaccacccttcgacatactcgaatattgcctggtgggctgccttgcgggtcggccaggtctggcggtggatgagttctgtcttgatcgtggcgaagaacgactcggcgaccgcgttgtcccagcactgcccgcgccggcccacggacagccgcacgccgtgccgctgcgcgaggcgggcgtgctgagcactcgtatattgacagccgcgatcggaatgaaagaccaggccgtcggcgggacggcgccgggccagggcatcggtcagggcggcgtcgaccaggtcggtcttgggatggtcggcgactagctagctagaaccacccggcgcgacgcgaggtcgatgacggtggccaggtagagccagccctcccacgtgttgatgtaggtgatgtcgccgcaccagcgggtatcgaccgcggtggcgtccacccggaagttgcggtcgaccaggtccgggcgggcgccggcgtgcggatccgcgaccgtggtggtcttccaccggcgcgggcacttgccggcgatcccggcagccctcatccggcgggcgacgcgtttacggccatgtcgcagcccggccgcggccagcttagcgtggatgcgcggcaccccgtaggtgccgttggaggccgcgtgcaccgcgatgatctgctcggtcagccgggcgtcgacgcggtcccgggtggactgttcaccgcgggcgtgctggtagtaggcggaccgggagaccttgagcagctcacacgcacgcttgacgttgtgcttgccggtctgctccgcctcgatgaacggatacacgttcaccgggtctcccgcgcgaaaaaaggccgtccgtttgaggatgtcgacgtcctgcggcaaccggcggttctccgctcgcagccgggccagctcgccgcgttcgtcggaggtaagcccgtccgatcgggtgccggcgtcgaggtcggcctacttgacccacgctcgcaccgccgtctcggtcaggtcgaaatccctcgcgacctgccccaccgtgcggtcaccacgctgacacaactccacgatctcggctttgaactcgggcgtgaacgcccgccgcggcctcgaccgcttctttcccacgctctccatgatgctggacaacctcccggagaccccaggtcccctgatcttggatgtccgtcaaaacggggcaggcccaatgaaatgcggtcggtattcaggaggccgcctatggatcagatgctctcgcatcttggctgagctggggcgggtgacggcggccgtggtgatccgagggcgcattgaagcggaccgctgttgctcgggtcagagtgcccgacctgcgcaatggggtgcctggaccggcgctacggccggcgaatttacgcagggtgacgacggtgctgggtgatccgtgggtgatcggatgtcggcgaccgttccagtactaccgcgactaaatcagcacggccgtgtcggggtcatcggctccgatggtgctggaatcatgtactcggctgcggcctgctgaaacgtgaacagcctctgagctggcgcaacgctttcggaatggcggcgtaccagacaagttgcagagtgtgctaatgactactaggcgtctgactacggatcagaaggttaggggttcgagtcccttcgggcgcacttcatcatcaagggcctgagctgcggaaacgcggttcgggcccttggctttttcggccctgcggacggtgggtgccggttgggtgtcaccgtttccgcgtcgaatagggcggcggtgaccgcgtgacctgcgatttttccgcgatctggtggcggagtcgccggagggtttttgtttttcgtcgcggccggcgggccggttcttcgcggtcctctgcttgattggtttgcgggtgtgccggggcgcggtggtggggccgacgtgtccgccgccacctcagtcgacggccgctgagctcacctcggcactcacgccgtcgacggcggcatgcccgcctcggcggcctccaccgtgtcgtaaacattcaccacctgatccaccgccgccacccgcagcacgtaagcgacgaggtcctgcaccgcggcgacgcacaaccgaccgcctctgctctgcaactccttgaaccacacgatgagagcgcccagaccgctggaatccaggaacgacacgtcggccaagtcgagcaccacccggacgccgccaccgtccgcgacctgctgaagaaaggcctccagctgcggcacagtgtccgtatcgacttcgccgccgaccttgaccacggtgcacgccccacttgtccgcgctgacaactgcagatccaccacagcctccggaaccgacacgcttcaccgatcgcccgctggcaacccatcacctcaataacccgcagcgacgctggtcaacccatgcactccccaccctgcactcaaatccggtctcgaaatccgacagcccacccggtccacatgccggccaagcggtgcccagtggagttcaggccatcccgctccatggtgaggtgatgaacgccggatcggccgactcgcaacggcggcggcttctggatgaacgcgagcgctacctcgctggtcgggaggaggcggcggatcggcgtgatgccgaggccgaccagcgggagatcgacctgcagggccggctggcgcgcgctgatgagcgggaccaggcagcggaccggcgggagttccttctggactgccgggattccgcggctggcaggcgcgaccggcgaagcgatcaacgcgacgacgccgcagatcgacgcgtggctgatggcgaccggcgcgacgccgtagcggacgccagggacaggacggccgatgttcgtgatcaggtagccgaccagcgtgacaaggacgccgatcaacggcatcgaggtggctgcggcgaacttgcgcgatgagttgccgccggccccccataccgggaccggctgacggggagctcctcatccggcccgcatacctgcgctcgcccccagtgcccgactcacgttgacgatcgtcatcccgcggaaaaccgtacgccccgttcgaccggcacggttcgaagcgcgtgaacagtaggtgccgggctgcagatcgcagagcggatcgcgcaccgccgtgctggaggaacaggcctgcaccggaaggccgtcggggccgaagatccacccggggccgcggctgtagtagtagccccaccggcagacctcctggcgtcgaggtcgtacacggacacccggaccagatagaggctcgccttcggcaccgtgaaggtgcggcatgcaaccgtgctcaccgagtcgttcggcgccgcccgtcctcctgcctgctgacgggttgcgggagcacggatcagaccggccgtggccgaccgccggtgatgccgttctcgtcgggagccggggaaagggcgtcgccgaccgcgacgagcagctggtcggcggtgaacggtttttcgatcaccctggtctcgggtgtgcacagacggttggcgccgaggttgccgtcgatgtaaccggatatgtagagcacgggcaggcgagggtcggtgcggtgcaggatctcggcgaggcgggagccggacatgtcgggcatgacgacgtcggcgatcagcagatcgcagccgtcgtccgcgtatgcggccagggcgtcgggaccactcacggcggaccggacctggtatccgccggcggcgaggatgcgagcgacgctggtgccgagggccggttcgtcctcgacgatcaggatgctctggccgtggccacgcggcggtgccacatcgttgcgaccttccgattcctgaccgtacggcacgtcgacggcggggaagtacagccggaaggtcgtgccgatacccagcttggagcagacgtcgatgctgccgccggccgtgatgacgatgtccaggacggtggcgagaccgagtcccgtgccgtggcctttcggcttggtggtgaagaagggctcgaagatgcgggccaccgtttccggagacatcccggtaccggtgtcggtgacgagaagctggaggtaacgtccggccgccaccggcgggtgcacgttcgcctggttctcctcgaggtcgacggcgctggccgcgatcaccaaggtgccaccgtcgggcatcgcgtcacgggcgttgacggcgaggttgaccagaatctgttggatctggccggtgtccgcgcagatcttcagcggctcgggcgagggcatcaccaccagctcgatgtgttcgccgagagtgcgggccagcatggcgtgcgcttcgttgatcgcggcgttgatgtcgaatatctgcggctggatggcctcgtgccggatgaagcagagcagttgcgcggtgagcccggccgcccgtttcgccgccttgcggatctgcgcgagatcgtcgagtgcctccggggaagcgtgttcggcgacgaagtcggtgtagttcaggatgatggcgaggacattgttgaagtcgtgggttatccccccggccagacgtcccaggctcgccattcgctgagcctctttggcctgctgcgcgatcgcccgttgtcgcgcttcggcgaggatcgcgccgagcaccgtcagggcggcggcgacgatgctcaggatcaggatgtagcgccggatggcggctcccaccgcgtcgagacggccgatgctggtgtccgccgccgcggccgacagcgcggcggtggcgtcacaaccgttggcgatctgcccgtagagctggatctcccggccgaggacgagttcggaggcggccctgcggtcggccggcttgccgctgcggtacagcgtcacgacggtccggtcgagggtcatgaaggcttcgaacgcctccctgacggcgtcgacggtccgtgcggacggggacgacgccgacagcacttccagggcgtccagttcgctgtcgaatttcgccgccgcgtcgaggaacttcgcacggctgggtgaggtgtcggcggtggcccccggtacggcgcggatgatgtccaatgcgtatgccgtctgccagccgttgaagtcggccgcccggaatttcacctgctgcgcggactcggccaaccgctgcgcctgtcgtgcctgcccggccatggtctcctggcggtgggacaccgagtagcccaatacggcgacggccaccaacaccgcgatggtgatcgcgttgaccaggaggcgccttgcgagccgacgcttcgacagccagcccatctgctgtgtacctgcccttcgccgggccactggaaccgcagcgtgccggctgtccggagcgccgtcgagcgaaccggcgataccggcgataccggcgcggaattattggtgattctccccgcaatagtcgtgtagcgctctgttttcgggacggaacgggccggcgctggccatcggccaccttcgatcacgggcgaccgtggatttggcacaccaggggacatccgcgctggacgatgccgttgcaggtcacggtgggtgatggcggttgaccgaggcgggatcgcgacgcgatcggatttactggcacggcgatggttgaaccgggcgccggaacacctcgtacccgctgctggacatggccgtccacgtgggaaaacagcagggggtgttccgcttgcgggaacgcatctaccgccgattcggaaggtggagcaatcggcggatcgcggtgatcggcgcggggatcgtggtgctcggggcgctcggggtgggaaccgggatgtcctatgcggggcagaacgatgccggggccgagccgaatacgaactgttcgctgctcgtgccggcggatccgctcagcgctgcggggctggcgacgccgtacgagctgtcggggaccgggcgccggcgcggcgcgtgccatgaggcgaatcctgcccaggccgcgtttgtgcaagccagcgtggtggatccggcgaccggcaaggtcagcgtctacaacccgttggtgatcgacaaggggacgcggccggtgctggacccggtggtgccggtgctgccgaagaacgcggtggtggggatctggttcgggttcaacggggagaacctgagactggtggactcgcacggcagtctgcgcggcggcgcctgcgtgaacggggtggacggctcgctgttctcccagttcgcgtactgcaatgcgccggcgttcttcagcgcggcgcacacggcgatccgggccggcaaactgaaggtaccgccgctcggcaccggccgggacgggaagccgtgcccgacgacgcgtgacttcaccgtcgtggaccaggaccagagcgacaacgtgacgagcgcgtacctgatccgtggcagccatgtcgcgcaggacaccgcggccaaccgggcgcggctgcggcatgcgccggtactggtcaacggcagtgacaacctgctgctggtgcacttcgtggaccaggcactgggctgcacgccgttccaggcgccggacctggccgacaacggcacgctcaccacctcgctggcgctcaacgagttgcaggcggccgcgaaccagcgggatccggtcgcgctggtgccgccgaacgatccgatggccgaggtggacgggcgcttcgaccggacgaagctgaacctgtaccggcagggtgtcggcatgggcaccgtctccgggactcgggggctggcagcgccgtactgtcagcaattggttgatctggcgccgagccggttgcgcgccgaccgccgcttcacccagaagatcgcgtcgccggatccgggggtggcgaccaacctgttcaccttcctcgcgcagcgactgagcgggtcgtacggcaatctggggtgcgaccggctgatccggtcgccgaacccggtgcggctgcgaacccgcgacggggtggccgtcgacgcgtcgttccccggagcgaccgggaccccgaccgcgaccccgtcaccgaccgccaggcagacaccgaccgccagcccgtcaccgaccgccaggcacaccatgaccgccagcccgaccgtgaccgccagtccgaccgtgacggccggccgcaccatgaccgccaggcagaccatggccgccagcccggccccgagcagcgcacggcccagtagtgccaagcccggcagtccggcttccggcagttcgccaccgggcccgagcgagagcaccaccgtcccggacgacgcctccccgagtatcgagacggtcgcggccgacaactacacctactcgaacgacggcggcgcgcccaaggtcaccgcaccggaagccgccgccctgccgcccacccggaacgtcagcttcctggcccgcaccggcggcggctcgatggcgctgatcgccggctcggtgctgctgaccctggtcggtctgtcggtgctcgccctccttccgcgccgccggaacccgggcacgtactaccggtgacgcccggccccacagcacccgggacactcccgagtgctgtggggcgcggcctgggggtgggcgtagcctttgggcgacagcctccctcaaggcggtggccatgcgagagtcgtccggacatccggctcctgccaggtctgcctcggtaacggtcgaggcccttctggcgcggcgcggtcgcatccaacagggcctcatcgacgcggagatacgcgccacccggcgggcgatcctgacccagttccgcctgcgcctgcgtgctgacgtgggcacgctgtccagcaccgccttcctcaccctggccgatgagcccgccgtccacaccgccatcatgatcgcagtcagcggtgtcgcccgtccggatgcgctcctgctgcacacctgtgctccgggcgcggctccgctgcggctgacacggcaccgcggcctgccggaatccggcccgcatcaggtcgcccggatcggctcggcggtcgcctccgtcgtcccaccggagggggacagcgccggcccggtggtggtccacgatctgagcgccgccgtcgtcggcgtgagccggttggcgacgcggatgctgctcgatgcgggattccgcgcggtgcagtgctacccgatgcgtgatggggacggaccacggctcgggctgttgtcactgctgtaccgctcgccggaccggtatcccgtccaggagtcgctggcccggcatgccggcaaggcccttgcgcatctgagcgagacgagaatcgggacatgtccggtggtcgcgccgtcggccttccccggacccccggcttcaccaccggatgcagcgtgcctctccggtcttctcgcggtcgaaccctcaaggccgggagcgaagcggtcgaaccctcaaggccggggagcgaagcggtgggccggtgaacgaagcggccggctggccggcgttgacggcaagccgctcagcggagctcgatgacacccgtgagcctggattccgacttcaccgggacgccgggccagcgggcggccgcctgcctcgccttcgctgcacgcgcgcgtgcccgagccgaccagctggaacgtaccgcgcagacgctgatcgaccgggccgcggtcgcccaccgggccgccgaggatgcgtccgcgcgggtcaccgggtcgtaccccgcggcgcggcgtcagctcctcaacgtctcgctcggggacacgccgtaagcggctcgataggccgcggcgaaacggccggtgttggcgaaaccccaccgggccgcgatggcgccgacggtgtcgccgcgatggcgccgacggtgtcgccgcgggtcgggtcggcgcgatgcagctcctggcgcgccaactcgaggcgcacccggctcagatatcgcagcggggtggtgccgaggtgccggcggaattcgtattgcagggcacgggcgctggtcccggccgccgccgcgatctcgctcagctggacaggcaggtgggcgtcggcgtcgacgaaggcgacggcgcggcggacggcgcccggcgtgacggcgcccggaccgggcacatgctgccggcccatggtcgtgttcgggaagacgtgcagggcgccggttgccaccgtccgggccaggtcctcggcgagcagcggcgagttcaacggtgacaccggatcgctcagggccccgctgaccagggcgatcagggaccgccagtatcgggccatcgacgccgaaaccggcgtgatgccgtgaaaccgggtctgtgcggccggcatgtccgcggtgtcctcggcgaccgtttgatccgatcggccggcagtcgcagggtggtcacgtcgaagtggtgcatgtcgaactcgatcggaacccgagcggatagaacgcgacgtcagcagcggatgcgacggtcccgccgagcgggctgtcgatctgcacgctgccggtgtgcaccacgaagaacacgtagtcgtggaaacccgtaccgctggtgccgccgtaatcgatggacgtccgcacccggtcggcgccgatcaccggggtgtcgtgggtcagcgccgagaagcgcgcgccgttgcggaccggcgcgaagcgggacctgttctccgcctacatctgccggatgaattcggtgacctcggcttcgtcgctggacgagaacgacgatcgttgcacgagaccgggctgggacgtcgacatgagagcctcccgccctgaatgctacgcagccgcggcgtcaccggaagggggcgtgcacgatcgggttacccgccggaccggcgctgggtgagccaccgcatcaggtgcagggcgtgcgaggcggggtcggggatcgggtggaagacgtgttccacccgatcgtcccggacgatgagcgtcagccgctcgtagacggcgaggtcaccggtggtgtgcacgggcaggccggtggcggcggccagggtgagcttcgggtccgggatcaacgggtacggcagccgtagccggtgcaccagttcgcgctggtaaccggtggactgggcggacaggccgaagacgcgggccgctccggcggtgcggatctcggcgtggtggtcgcgcagccagtcgccctgaccccgggcgccggggatctccagcaggctgcggggcaggtcgacgccgggccgaccggtcagcggatacacgaagatgacgctgcgtcccggcccgaggtggtccaggcggagcgggcggccgtcggtggcgtagaagtgcagctccggcaggcgtcggccgatcagaccggctggcggcccgccggtgaccggggtgccggcgacgatccggtgcgcggcggcgtcgatccgggcgtcgagggcctcccgctgggtggtcagctcaccgatgcgcgtctgcaggctggtcacggtactgcggaaggtggccaccgcggcggcgcagacgtcgtcgtcgttggcgatcgactcgacgaacgggcgggtctcctcgacggtgagcccgagcgccgtcagctcgcggatctgggcgacctgccgctcggcgatcggctcgtaatcccggtaaccgttgccgagccggcggggcacgaccagccccacctgctcgtagtaacgcaacgcccgaatcgtcgtgccggtccgacgggccagttcacccacgcgcatgccccgaccctaaacccgtacccccgggtacaggtcaacgcgattctcctcgcgatgacagggccgccggcgaccggcgagtctggtcgggcagacgtgacaggagcaggggagagtgcgatgacggcgatcagccgggtgatcggacggcagatcctcgacagccggggcaacccgagcgtcgaggtcgacgtggtgctcgcggacggctcgtccggccgggcagcggtgccgtcgggtgcgtcgaccggggcgaacgaggcggtcgagctgcgcgacggtgacccggaacgattccacggcaagggggtcagccgggcggtggccgcggtcaacggcgccatcgccgcggcggtgaccgggctggaggccgaggaccaggcgctcgtcgacacgacgatgatcgatctcgacggtaccggggacaagggacgcctgggcgcgaacgcgatcctcggggtgtccctggcgacggcgaaggccgcggcacaggcgcaccggcagccgttgtaccgctacctcggcggggccggcgcccggacgctgccggtgccgatgatgaacatcatcaacggcggcgcccacgccgacaacccgctcgacttccaggaattcatgatcgcgccgatcggcgcggagaacttcttcgaggccgtacgcatcgggtcggaggtgttccacacgctgcgtcgccggctggccgcggccggccacagcaccaacgtcggggacgagggcggattcgccccgaacttcgccgacgccgacgaggcgctgcgcttcgtggtccaggccgtccgggactccgggtaccggcccggcatcgacgtcaccatctgtctcgacccggccagctccgagttctaccggggcggcgcctacgagtacaccggggaaggccgcacccgcacggctgacgagcacatcgactacctgttggagctggccgcggcgtacccgatcagctcgatcgaggatccgatggccgaggacgacttcgccggctggcgcaagctcaccgcgcaggccggcgaccggatccagctggtcggcgacgacgtgttctgcaccgacgcggatcgcctgcagagcggcatcgacggcgggtacgccaacgcgatcctggtgaaggtcaaccagatcggcacgctgaccgagaccctccggaccgtcgagaccgcgcaccgggccggctaccgggtggtgatctcgcaccggtccggggagaccgaggacaccacgatcgccgacctggcggtggccaccaactgcggccagatcaagaccggctcgctgtcgcgcagcgaccggaccgccaaatacaaccagctcatccggatcgaggagcagttggggcggtccgcccgctacggcagcgctacttcttcccgctgatcgccttcaggtcgctgcgggcccctttcgcggtcgtacggatcgtcgtgacctgggcgcgcaccgccgcaccgtccgcaccgggctggatcgcgagcaacgcgtcgaccttgccggccagcgacttctgcacggcgtcgagcttggcgtcgtcggcgccgggccggtcgtgcagccggtccgcggcggccagctcggcgtcgatcgccaccgacagccgcaccttcggcccggtcagcatgaacacccggtagtcgaccaccatgctgcgcgcgtccgccttcagccccgcggcggtcgtctcgccctccaccttggacttcaacgcggtcaggccggccgactggccgtcgatgagctgctgcaacgcctgcttgtgggcggcctgcaggtgcttggccccgccgagcgcggcggcgtccttccggagggcgtcgagccgcttgtcgatccgggcggccaccgccttctttaccacgtcgaggggcttggcggcctgcgcgggcgacccgccgagcgcggcggcctccgcgggcgacccggcgagtgacacgccgagcgcggcgatcagggatgcggtgagaacacggtgcatgggggacctcaatcctcgtcttcagcgggttgatcgtcgtggctgagctgggtgccggcgtcgtcgaggagcgagtcgacgccgtcatcggcctgcgtcgccgccggagccggcgggttcgtcgcccgtggcgcgccacggtcgcagccgccggtgatcagcgcgccgagcatgagcgcgacagccagggttcgcttcatgaccacgatcctgcggaccgcgggtcagcgccccgctcgcagtcggtaagagtttcgttaaggacggtcgggagctgagcagtcgagcgcggcgtacggggtccgtgcgatcgggcccccgacctcggcgacgagcgcggtgaacgtgctcaacaacgttgttgcacggggcatggggactcctacaggcgttttgagagcgctctcaatccggggaggggaatcgccactgtcaatgtcgctgactgacgagcggcgtccgatgtggagataagcccaggtgggagcgttcccggcgcccgaggggcttgaccctaccgggaaatgggcgctattggatcatgcaaacggacgagccgcacccgcaccgtcgcgacggtaaggtcccgacgtaatatggggcgccgcaggaatgagaagcgtcgattcctggctggccacaaagcgggttaccccccaaccctggagagaggttccacacatgctcggacgatcaggacggcgctgggcgcaggtcgccatggccgctgccgccggcggcgcgctgctgctcggtgccgctgcccccgcggccgccgacgagcccaccaccggtgttccgtcgcggatgaccgacggcgccgtcaccctggtgctgggcggtaaggcccactcggtcggtggcatccagttcaccatcaagggccagaccgtcccgatcttctgcatcgactaccacaccgggctcgcggcgaacgagccgtacaccgagggcacctgggacgagtccgaggtcaaaaacctcaccaaggtgcagtgggtgctcgcccacggctacccgaacggggacatcaacgccctgctcaccgccgcccacgtgcagatgccgcagctggacgaggcgcggcagcgcaagctgctgtacttcggcacccagaccgccgtctggcacttcagcgacggcatcgacctgggcgcgtactccgacggcgcccggctcaccgacaagccgcagtacgacgtggtcaagggcatctacgactacctgaccaccaacgcggtggaccagccggagccggccgcccagctgaccgtcaccccggccagcgccaccgccaaggccggcgagaaggccggcccgttcaccgtcgcgggtccggccagcgcgatcagcgtctcggtcaagggcggctccgcggtcgacgccgacggcaagccggtcaccagcaccagcaacggcggcaagttctggctgaccgcggccgacgccggcaaggccaccgtcaccctgaacgccgaggactccgtctcgttcggccgggtcttcctgtacagcggtggcaaggacaagcaccagaagctgatcctgggttccagcatcggcaagccggtcaccgcgtccgccgaggccaccttcaccccggccccggtcaccacgaccaccgccgcctcgccgaagccgtcggcgtccacctcgaaggcctcgcagagcccgtcggcggccgtcccgggcgccagcaccagcccgacgtccggtggccacctggccctgaccggctcggccgccagcacggtcgccggcggtggcgtggtcctgctggtcatcggcggcctcgcgctgatgctggtccgtcgtcgccggacccgcttcaccagctgatctgaactgatctgaaaagaggcccggcccgcggcgacgcggaccgggcctctttcgcgtctcccgggccgggcacggaagaggggccgtgacccgcgggtcacggcccctctcatgctgccggctgtacgcgtgtcaccagccgccgacgccggccaggacccgctccaccgggaccggcttgcccaggtagaagccctgcccgaacggcaccccgcaggccaccagcgcatcccgctgcgcggccgtctcgatgccctcggcgatgatcgtgcagccgtgctgctcggcgaactccaccagggtccggatcgacgcctgccgcgccgtctcgttctccaggttctgcaccgtgtccaggctcagcttgaggaacgccggccgggccgattcgagcagggccagcgtctcgtagcccaaccccaggtcgtcgaccgcgagccggacggttccgcccagctgcccgacctcggccggcaccgggccgcccacctcgacgatcagcggacgcttggcctcggcgagcagcggcgccagctcgtgcgggcggcgcagcaggtcggtggagacgttgacggccagccaggtgccgttcggcagcgacgacgacgacgcgatggccgcctggaccagcgcggcgtccagggcgacgtgcacgccgcgctgggcggccgcctccaaaccctcgcgcgggttgctgccgtcggcgaagcgggtgagcgcctcgtacccgaccacgtgcccgttgatcatgttgtggatcggctggaacaccgtgaagaagctgaactcctcgaacaggtgcgcccggctcgccgaggtgggcctgtcggtcttccacgcgccggtgtcggtgcgctgcagccgcacggtgacctgcccggcggtggcgccggtctcgtgccggtagtgcagcacggtggcccagtcgccgatcgccgccgccttgggcgcggcggccttcttcgaagccgaggacttgcggaccttcttcggggtggccaccggcaccagccagtcccgcagatgggtggccaggtcgacgacggtgttcccgaggccgatgaaggcgatcaccgcgtacagcgacagcaccaggttcaggccggcgaagaccaggttgttccactggtgcagccgcacgtcgtgccacaccgtgtagaggcagagcaccaccagggccagcggcaggagcaggtagctggtcgcggtggtggtccggttgcggaccttcggcgtccgcttgaacgcgctcttctcgccggtcagcagctgcagcagggaggcgatgctgccggagaggttgaccggcagcaggatcaggttgaagccgtagatgcgcagcatgtcggtccgcttgtacccgaggtgcttcaggtcggccgccatcatgaagaagtacggcaccgagatgagcagcaggaacgggttgagcagctcgttgttgaacgggtacaccagcatgatcaccaggcacatggagctccagaagatggacgccatgtagttgacccgcaggaagtactcgccgaaccggttcttgtcctcgcgcttgctcttcgccttgaactggtccttgagccgggacaggatcagcaggccgccgttggcccagcgctgccgctggatggcgagcgagccgaagtccggcggggtcgcgctgtaggcgagccgttccgggtagttgtgcagggtccagccgcggacacccaggtcgatcgtcgactcggtgtcctcgatgacggtccggtcctggatgtagcgcttgatctcccagtcgccctcgtacgagacctcgcagatctcgtcgagagccttcttgcggagtacggcgttggcccccacccagaacgtcgcaccgtagtgggtcatcccctggtgcacgatgtactgaatgtcggtggtcgcgccggagatccgctccacccgggtgcccgagccgggatatgcgctgtacggcgtctgcaccaccgcatgctgcgcgaacgccccctgctccatgaggtggaccagccgcagtgcgtactcgggaagcagcacgctgtcggcgtccagggtcagcacgtagtccgggttcggcaccaccagatcagcccggttcggcccggccgtcaccagcgcggttcccagcggggtgttgacctcctggtacgccccgcccatcagcccgatgtagctgttgaggttcatcgccttgttcggctcgtgcgacagcgacacgtacttcttgcgctcgaagctggtcacctgcgcgtcgaagatcgcgaggagccgcttgtgcagctggttcatccgcggcagcggcagtgccacctgctcgtcggcacccttgaccagcgcgccggcgatctggcccagctcgaccgcgagcgggtgcaggatgtgctcgacgaagaaggtgtcggtgtggtcgaccatctcctgccgggcgcccaggtcgtacagccagtcggaggcgaaccggtactcgtcggcgagccggcgcatgtcgtccgggaccaccagatggccgccgcggaaccgcacctgctcgtcgaaggccgcgaacgcggccgccacccgccggtacggaacctgcagctcagcctcgatcttgccgggcagcgcccgggcggccagcagcatgtcccgggcggcccgggtcttcggcgcccgggggtcgtcgatcagcagcgtgacccgcagccccggatattcctgcagagcggcggagagcagcgtgctgcggttggtccgctcgtcttcctgatatgacggcaccaaaaccgtcaaggacggggtcttgccgccgatgaactcgtcgagcatgatccgtggcgcccgctggtgaccgcggccacgatagaagtagccgatccgggtgatcaggtaggcgattgcggaagcggcgagaccggtgatgacgagcatataggcgatcgcctcggcacccagccgtgcgttgtacgccttaccgacgatgaattgctcgaaaatcgtataggcgatgtaaccggcccacaccgtgatggtcaccacgatagcgagccggccccgggtgatcctgccttcggataccgggggcggaacgatcggatgaggatcagtccgccggtcggcgccccattgtcgctgggcgtcccgcttgcgctggtccgccgatgtggatgacatgcgtgtttgggcccttcggtgcgaattgcgatgacgcggagagacggcatccggcggaattgtcatcgcaagatcaggatctggcgctccggattccagattggacgacttcccccattcacccgatcgcggaaatcgcggatgtgggtcagcgtttagcgactccagggaaagggttttcatgacggaccgcgccacagccgtagccgcgcgaacgggtatcgatccgctcgccgacccggattggcaggaaccggagcagccgcgccgccggctgtcgtggacgaggctgggaatgctggtgctcgcgctcggtgcggtcggcgccggcggcaccctcggcgtgatgcatctgcgggacacctccggtccgaccgcgaagtcctgggcggtgccgtacgtcgacgtcacgctgaccccgaccttccagttccaggacccgaccgcgaacccggccaagaacgtggccctcggcttcgtcgtcgccgacccgaagagcgcctgcgcccccagctggggcggcgcctactcgctggacgcggcggccacctcgctggaactcgaccgccggatcgaccagttgcgccaggccggcggcgacatcacgctgagcctcggcgggctggccaaccaggagctcgcggtggcgtgtgccgaccaggccaagctcaccgacgcgtaccgccaattggtgaaacgctatgacgtgaagacgctcgacctggacatcgaaggcaccgccgtggccgaccaggcgtccctgcagcgccgcgtgacagcggtcgccgcggtgcagaaggagcgggaggcggccggcaagccgctcgccgtgtggctgaccctgccggtgacgccgaacggcctcaccgacgacggggtcggcgtggtccgcggcatgctcgacggcggtgtcgcgctgcgcggcgtcaacgtgatgacgatggacttcaacaacggcgacagccacccgaacatgctgggcctgagcaccagcgcgctggacggcacccacaagcagctcaccgacctctacctgcggctcggtcagaagctcacctcgccgcaggtctggtcgcggatcggggccaccccgatgatcggccagaacgacgtcgacgccgaacggttcaccgtcgacaacgccaccggcctggccacgttcgcggtcgacaagggcctcggccgggtctcgatgtggtcattgaaccgggacgcgccctgccgcggcaccttcgccaacgtggtcgtgcactccaacacctgcagcggcgtcgaccaggacgcgctggccttctccaaggtcttcgccggtctgcccggcaaggcggccggcagcagcagccaggactcggtggacatcccgaaccaggcggccaccgtcgacgacccgaagaccagcccgtacccgatctggcgcctgaccgccctctacaccggcggctacaaggtggtctggcacggcgtggtctacgaggcgaagtgggccaactcgggcgtcgacccgtccgccgcacccgccgccggcacgcagaacgcctggtcggtgatcggcccggtgagcccggtcgagaaggcccccaagcccaccccggcggtcaccggagtcaccaggatctggaccccgggcaccgcctaccagcgcggcgaccgggtcctgttgaacggcctgccgtacgaggcgaagtggaccaccaagggcgagaccccgtcgaccgagttcccgatcgacgccgacgacccctggcacccgctcttcaacgtcccgggcgaacccaccaccaactgacagaacccgattcgccggtacgtccatggtccgcgcccgatcgcgcgtcgcggacgtaccggccgggacatcaccacgccacccggcacgaccctgccgcgccggccccttcctcgacgtcttccgcttcctcctgcgcatcctgcgcggcgccgaccgctgaagcggcgcagcgcccggccgctcggccgggcgctgtcgcaggatcgtcagaggctgcgggcggtgatcgtgccgtaggaggtggtggcgcggatcgccacctcgacctcgccgccggcgttgcgcagcgagttgacgatccggccgtacgaggtgcccgcgtccagcgaggcggagacccccgccgcggtgtccacggtgatgtcgccggcctgggtgctcagcgtcaggtcgccgccggaggtctcggcgatccggatgtcgcccttctgcgtcctgatctcggctgccccggtgagccgtccgatggtgacgtcgccggcgtcggtgctgacgtcggcgctcgccgcctcgtccagcttgatcgcgccgtgtgcgccgcggtggacgacgtcgccgagccggccggcgccacggaactcggcgctggccgcccgcacttcgacccgggagccggcgggcaactggacggtcacctccacggacccggaagccccgaagatctgattcttcgcctcggcgacgatccgcaggatcccgtcggtgaagtcgaccgcggtctgctcggcgaccttgacgtcgcggctcttcgcggcgtccagcggccggacctcgaccacggtgtcggtgcggtcggcggcgatgacctggacccggccggccgggatgtcgatgacggcggcgatggcggtgcgggtgtcgtacttcttcatcgttctgccctgtctgctcggtgtttctgacatgagaaacgctacgttgcgttcgcagaacgggcaacatactcgttgcgatgggtaagcatcactgcagctcagggttaggaaatcattgcaatggtgatgaaagtgaatgcaacgccgttgcaatggaatagcggtgaacgctacgctgagccgggaccggggagagggagtgcacgatgccgggcggcaggctcagtcagcaggaacgtcatcagatcgcgctggggttggccgacggcctcgcctacgcggagatcgcccggcggctcgaccggcccacctcgacgatcacccgcgaggtgctgcgcaacggcggtccggccggctaccgcgccgacctggcccagcacgccaccgagcgccgcgtccgccggcgccggcagtccgccgcccgcggcccggagacaccggcgtcgccctccggtcgcgacgacgccgccatccgggagtacgaggagtccttcaccgccgtcctgatggcctccggcctgccccggatggtggcccgggtgctgacctgcctctacacctccgacaccagcccgaccgccgccgacctggtcggccgcctgcaggtcagcaaggcctcggtgtccaaagcggtcgccctgctggagagtctcggcctgatccgccgcgagcgcgacaaaagtcgccgggaacggtacgtagtcgacgacgacgccctctatcagtcgatgatcgccagcgcccgggccaacgaacggctcgcggtgaccgctcgggagggggtgcgcctgctcggtccggacacgctttccgcggcccggctggagaacatcgcccgcttcgccgacttcgtcggggagagcatcgtccgcgccgccgaacaggcccgtgccctgctctccaccaggccaccggccgccggctgaatggggcggcgcgggctcgcacggcaggagcacaatgcaggcgtgacgagagaaacgctggtcggccggatcggaacggtgatcaccgcgatccgcggcggcgagcgtgcgggggaggtgcgtctggtggtcgccggtatcgcgcactactacctcgcctacgcggccgcacccgttcctcccggttccgaggtgctcgtcatcaatcaccgtggcgcacgccaaatcgacgtcgagccatggcccatcgaagaagggctgtaggaatgttcggttatcgggtgcccgcccccaacgaggcgctgctcatcagcggtcggaaacagcggggtgcggacgcgttgccgttcaaaatcgtcaccggacatggcgtcttcgtcatgcccgtcttctccaaggccacccgcctcacgctggcgatgcaggaggccgaggtggtcgaggactgctacaccaagcagggcctgaccctcggcgtgcaggcggtgatcgcgttcaaggtcggtgacgaccacgagtcgatcgccgcggccgcccgccggttccagggcgaccaggggcagatgcccacgctggtcggccggatcttctcgggccacctgcgcagcatcatcggcagcatgacggtcgagtcgatcatccgggagcagcagactctcgcggacgcgatcgtcgacgccagcaagaccgagatggcccggatcggcctcgccgtcgactctctgcagatcagcagcatcgacgacaagggtgtcggctacatcaaggcgctggcggcaccgcaccaggcccgggtcaaccaggaggcgcaggtcgcccaggccgccgccgaccgggagagcgcgatggcccagcaggagagcgcccgccaccaggcggagtactcgcggcagacggcgatcgccaaggcccagttccaggccgagatcgatcaggctcaacagaccgcgtcccaggccggcccgctcgccgccgcccgggccgcccaggaggtgctcgccgagcaggcgctggtcgcgcagaagaacgccgagctgcgtcaggcccagctgatcgccgaggtggtccgcccggccgaggccgaggccgagcggatccgcgccctggcccgcgccgaggcggatgccaccaagctgtccgccgaggccgccgccgcccaggaccggatcgccctggaccaggccatcatcgacaagctgccggagatgctccgcgccgccgccgagggcctgcagggtgccaacgtcaccgttctggacggcgccgagggcctgaacagtgtcgtcgcctcgctcgccgcccagggcatgaccatgctggagacgctgcgcagcggcatgcgccccgagccggcccagccgggcaacgcggtcgccccgatcaacgccaagtcggtcgcctgaccccgccgcggcgccgggctccggcccggcgccgcggtctttcccgtgcccggtacgccgtgccgacccccgtcgtgaccggtcgcggagagctcccgccggacgccgctcgatcgtctccgtcgagccgcaccgagcgccgattcccgtccgggaaagtcactgaaaattcatcgcgagggcctgtttcgacaaccgtctttggacgccggtacggacccgtacgttccggcggcgcaagatagccgttcggacagtttttcgccagtggtgatcgcctcaaacccgctggccagggcttcgtccaatttgctgatatcgaaacagcaactttcctgtgaaagggtctttccaggtcaagatctgacttgttagcgtgtcgctcccggccttacatcgagccacggaagatcacggatccatcgacatcccttgtgatcaaccgagcgctgacatgcggtgtacgccgggtcacgaggcccccttggcctcgtggcaaatcggggaaattccgacaggagacttcgcgtgcccaagaagaccacgcgtcgccgcatcgccagtgcgctgacgggggtgtcagtggcggccgctgcggtcgcgctggttcagcttccggcctcggcggctggaagcaccggcggaagtgcgctgctgccgccaattccggcgaacgcccgccacttcgcactgccctacgacaagatcccggccggagccgtgaaggcgaagaccggtccgctgaaggccggcaagcgcgccaaggccttccagacgccgggctcgaagacgaagatcgtcaacggtgacatcgcccactcggcggacttcccgggcgtcgtcggcatccagtccgacttcatcgccaatgacgccaacggcaacccggcgtggtggaccagcacctgcaccggcaccgttctcagcccgacccgggtgctcaccgccggccactgcacggtcgacctgccctacggctacacccaggtgatcgccggtcgggacaacctggccgacaacacctccggtttcgtcgcgcgggtctccaacacctggctgcacccgagctacaactaccaggcgcaggtcaccgacccgcagaacaccccgccgaagaacgacgtcagcgtcctggacctgaaggacgcgctgcccgacgtctacaaggcgaccgacctgatcgcccagggggcggccgacccggccgccggccaggacgcgaccatcgtgggttacggcatcaccaaggagggcggcagcgactccggcgtgctgcactccgcgacggtgcagacccagaaggacagcacctgcacccagccgagccagttcggcacccagttcgacccgacgacgatgctctgcgccggcgacgtggtcaaccacaaggacacctgccacggtgactcgggcggcccgatcttcctcggcggccccgcggcccgcgtcgagatcggcgtcaccagctggggcaacgtctgcggcggtgcctactacggcgcctacgcggctctgaaccagctctccggggcggtcaaggcgcaggtcaccaacctccagccgaccaacctggacttcaccggtgacggtcactcggacctcatcgtccgggagccgggcaccggctacctgatcgtcgcttccggcgccggcaccctggtcggcacgccgtacatcgacgagacgtcgtcgtacgacgtgggcttcaactactaccgctacctggacaagagccacaactacgaggcctactccaagctgttccgggtcaccaactggaacgcggacggcaacgagtcgatcttcggccgggaccggaacggcaccctgtggcagtggaagggtgacggccgcggcgatctggtctccaccacgccgaccaagatcggcagcggctggaacatgttcaccgacatcgtggtgaccaacaactggaacggtgacggccgctccaacctgctgggccgcaaggccgacggcacgctggtgatctacaacagcgacggtgccggcggctgggagaacccgcagggcacggtcatcggctccggctggaaccagttcaacaccgtgctgaccccgggctcctggctcggtgacggccaccagtcgctgatcggccgcaacgccgccggcgagctgtggctgtacaacagcaacggtcacggtggctggatcaacccgcgcggcaccaagctcggcaccggctggaacggcatgccgaccttcatgtccccgggtgacttcgacggtgacaacctggtcgacctgatcggtgtccgcaccaacggtgacctctacctgtacccgaccaacggcaagggtgcctggaagaacggccgcggcaagctcctcggctacagctgggactactacaaagccgtgttctgatccaccagcttcaccggacggcccccgcgggatctcccgcgggggccgctccgctttccggccggcctcacttcgtgaagctgtgcaggaggtcgatcagtacgctcaccagcagcagcagggcggcgagggtgagcacgcagacgaccgccgcggtcgcgtagtagaaggcccggcgccagcggcggtagggattgaccgtgaccatcgtcagttcaccccgtatcgccggagggtccaacccagcagctcgtgcacgttcgggtcggtcgcaccgggatcgaagaccgcggtggtgtggaagtagcggacctccccgaacgatttctcgatcgaccgcaccatgttcgccatccccacccggtcccggagccagccgcgcacgtcgtcgtcgatcccgtcgccgatcggcaggcccgcggtcaggtcgctcttggtcaccgcgaccgccagggccttgtccgcggtccgcacccccatcccggtcaggttgtccagcacctgctcgaagatgtagctcggcggctgcgcggagcggatcgcccggtatcgctgctgtgtcgcgggatccagcgagttccacacgtccgggatcgcgaacgggtcgatgaccaggacgaaggcgtgcgccccgcggaggaaccggcgagcctgcaggcgggccgagtcgctgaagtcctcgccgggcgggtcgtagatgtggaccagccgccgcacccggttcgcggtcaggttgaacgagtacgcccgcaccgcgtcctccgcgatggtcttccgggtggcgccccggacctgcagcgcctcccgcatctcggcgagggcgttcccggtcggcacatccgccggggtggcccgcggcagcagggtttccgccagggccagcatcatccgggtcttgccggcgctggtcgcgcccagcatcggcatcacgatctcgcgcgcggtgccggccccggaggccatcgccgcgtggcagtgcgggcagtacgccgtcatccggtggctgcccagcaccagcagtgtcggcatccggtagccgcacgcgcaggtgcgccgcagcagcccgtaccgtccgggccggacgtcctcgtgccggtgcgtgcactccgggttggggcagtcgtaggccggatacaccacccggtggtggcaggacgggcaggtcagtttgatgccgcgcaggtgggacagcgccgagtcgacgccgcgcagcaggtacagcaggctcttgcccagcacgaacagcaggccccagaccagcagggcgccgagcgccacgaagatcatcaccaggccgctgatcgccgcgccgccgaccgtgccgacggtgaccagaacgccgaccgctttgcgataactgctcatgctgaactggaagaattcgcgtttcagccagctccgggtgaggtccgcctgccgtttcgtctcctgcgcggtgagcagggcgacctgctgcaggtcacgcccggccggcccggacaggtaatggacgtgggcgggcacgtcccgcggctcgggcaccgggacggaggcgtccggccgtcgcacgcccagcgcctggccgctggccttgaggtaggcgccggcgcagcggacgaggatcacgccactggtgatgatgatcagcgggatgccgaggatcaggaaggcggccccgacgagcagataccaggcgatggtgaacagcaggggcatggtggtcaccgcttccgggggaggaaccggctgaaacggcccggcacgcgcgtctcacgccactgacggacgtaccccggcaagcctttgatcgtgcttttcgccagaaatctctccaggtcgtcgagatcgcgggtcttccaccgggcgaccgtcgcggtcagcacctcgtcgagctccgcataccgcttcgggtgggtgtgcagcagttcgaacgtggtggcggcgacggccaggtcggccggccgccggtcgagcgtgcggctcagctggtcgcggtagtggcgacggatctccggcggcacggccggcagcaactcggcgagtgcccgggcgtcctgtgtaaccagcagtgcgggcagttgggagccgagccaggcacgcgccggctggccgacatgtccaaagtagtcgaccaccgcgcgcgccggggaagccgaccggatcatctcccgggcggcgcggagttgctcgacgtgggtccgggcggccggcgacatccggccggtgagttcgcggaccgcggcgaagtcggcagcggccacgtagtgcggccatccgcccggtggcacctgggtccgcgccagcacccggtccagcagctcgaccagcgccgccgactcccagaactcgtccggggcctcgcggatcacctcagcggcctcctccagaccccagccgccggcccacagcgccgcgagcaccgcgcggtccggtccgagaaggcgcagtgcgggcacccgtttcgccggatcggtcgccgcgcgggacagctgcaacaggcgctgcagcgcggggtaggcctgcagttcggcatccggcgcgcccagctgttcgagggcgggcagcaccccgggatcgccggcgacccgggccagcccctgcagcactccccgccgcagtgccggcacgtccccgagcgggcgcgggtcgacaaggatcaagggcaggatcaattctcggccgtacgcggtcaactcctgatccgtcagctccaccccggcccggacggccaggtcgagcacagccgccgtgtccgcccccggcaccgccccgtcgagccgggtcagcacctgctgccgggcataccgccgcgcttccggcgtttccagccgcggcgcgggggcctgcgacggatcgcgcagcagcatgtcgaacgcgctgacctcggccgccgctcgcagatccggatcaccggcggccacctcgaccagggtgaggcactgcggcagggtgagcgcctcgtggtcgaggcacgcctcggcgatcggcgcgaccgcccggggcccgagccgggcggcgttgccgggcagccagtccagcacggcggccaggtccccgtcggtgaccggcagccgttcgcagagcgcggcggccgccaccgccgggtaccagccgtcgaaatcctccgccgcggcgtagtcgccggccaggtcccagaggatccgcgcgttctccgggccggccgcggtgagcagctcggccagcgggtgctcgtcggccgccgactccggcccgccggtcaggtcgaagaccgcgaagctgcgcagtaccggctcggtcacctcgaagccgctgcccggaaccgtgccgatcaggtgttcccggccgcggcccggctggtactgataggtggcgaaggcgaagcgccggaccatccccgggggcagcaggtcgcacagggcaccgatgcagcgggccacgtcggcgctccgctcggccacgacgatcaccgggcggccctcggcgacgacggcccgcgcgaccgcggtgagcatccgtggcagccggccgatctccggtgacgggtccggccggccggccggcaccggggtcagctccggcagctcgcgggagtccgactcggtgtggacccagaaatccgccgcccagaagtcgatcggccgcgcaccctcgaagccggcgggaaggctcagcgcgtgcacgaagtagttgccgagccggtgcgagtagtcggtgccgacgaacaccgtgcgggccaggacggccggctcaccgggcaggtagcagaggttcaccggggcgtccgcgatctgctcggcggtcggctcccagcccagcgagcgcggcggctgatacgccgtggcctgctccacccggcgcagcacggcctcgctgatcccgggcgtcaccgcgttgaactggaagccggggaagccgctcagcccggacaggcacgacgtgtagtacatctgcgggacgcccatcagtccctccccgtctcgatcaccttgagccggctgagcagccagaggaacgggtcggcgacgcggtgcggctggatgccggactcggccacccgctgccgggaggcgatccccacggacgggacggcgcccagggcggacagcgcgaaataccggtacgtccggtagtgcttgtgcaggagctggtcgatctgcccgccctcccattcctgcagcagcgcctgcacgtggtcgtgcagggccacgctgtcgcgttccgggaagaacggctcgtccggcgcgggctggcgcagcgggctgtccgcgggcaacgcctcccagagcacgtccaccttggagaacgcgatcgccaccggcacgtcgatcatccggtgcgggccggtgccgggcaggttctgcagcacctcggtgacccgggtgaggatgttgagcggggtgtcgccggccgccgccgggccgggcagcaggctcgggtccaggccgagagtcgccggcagcccgggcacggtcagcgggtcgagcagcacgatgatcccgtccgcgctgctcagatagccgacgttctgcgccaccccgcgcgccgactcgaggtcctcgccggcggtgtcgaagaacgacagcacggtgtgccgcagcgtgctgcggaaccgtttccgctcgccgagcgagaacttgaagacgaacggctgccgcccctgctcgtcggcccgggccggccgggtggtcgccggcagcacccgatcggtgtagagcgcgtgctcctcggccccgaactcccggcgggtccgctcgtcggcgccgagcaccgcggcgtcgaaccgccggccgacccggtggatcagctcgtgcatcagcaccgtggtgaagaccgacttgccgctgaacttggcgccgatcatcgccaccatccgggtgtcgagcttgccgtagtgcaccggcagctgcgcgtgacagtgcgggcagagctggatcgtcgcggtgttgccgcactgcgggcagaccgcggacagcttccggccgttggcgaccaccaccggcggcacctcgtcccggtcgcccagctccacccggaccggatcgggcgccggccggcagaacttcccgtcggccgcgcgcagcccgctgcagcggaacagcatgtcccgctcggcgaactgccgatagcagtacgggcaggtcagtcgcgccatggtcagccgccccccgggattcccttgagcaccacgtccgacccgccgccggccggatcgtcgacgaaacagcccagccggtacggcccgcgcgcgctctgcaccggcacctccaccgacaccgggtggcccggctcgaggcgctgcgccgggatgcgtaccaccgcggtgccctgatcggcgcgcagcggcacgatccggcccggcgactgcaccaccaccagatccggcagcgggcacggctgttcggcggtcagctccagccgggtccgccgccggaacgtgccggcctgcacgaaccggtagtgcaccggcacgccgccgccggccacccgcgcggtgaccggggtgccgacggtctcgccctcgtcgtcgcggctcaccgtggacaccgcgacggtgaccgcgccgatcccggggccgatctccacgccgccgtcgtcccggtaggcgcgcagccagcagtcgacctgccgggcctgctccggggcgtcgtcgtgccaccaccgcacccgggccagcgagacgccctccggccaggtccagctgagtcgcaccagcgggccgacccgccgggcccgcaacccgctgaccggcgccacattcgtcaccgtgacggtcggcccgaccaccacccggccggccccggtgctgaaggcggtcacgaacacccgccctgcgggcatcgggaccgtcagcgaggcgcggtccgctttccccggcatttcccggccgtacgtcgacagctccgccccgctgatctccgcgccccggctccaccgcggccggtgtgccgaggcgcgcaccgtcacgtcgccgctctccggcggcgtccaggtcagtcgcaaccgggccggacccggcccgggcagcggctccgcggtcaggccgggcaccgcggtcggggcggcctgcggggtggccgccacggtgatcccggccgacagcgcgggatagccggcccggatccggtagcggtactcgacgtccggtcgcagcccgtcgtcgctgaacccggtgcgcccggccgtgacggcgaccccgcccggctcccggaccacggtgcagccggtcaggtcgggccgggccgaccaggtgacccgcacgctcgtctcgtcggccgccacctgcaccccggtgacctcgggcagcagcgacaccggcccggcggcggcccccggcgaccagaccccgtcggcccgggtcgcgaacaccgtgtagaagaggtcgtcgccggccggggcgtccggatcggacagctcgttgccaccggtgcggccgaccacgtcaccgtcggtggccgagcccgccggccgctgccgggtgcgcaccacctggtaggtgactccgccggtgcgcgccgggccgggcgtccagccgatcgtcacccggtccccggccgcgctgccggcccgcaccgcggatgccggtggtggggccagcgtgcgcagccggtcggccagatcggtgtcgtcggcggcctcgcgcaccgcggtggccagcacctcggccgcagactccgggcgccccgcggcgatctcccgctgcgcccgtgcggccagctcgccgacccgcgcgacggcggccagcacccggtcgcgcacctccgcgccgtccccggcgggcagggtcgacagcagccgctcggccgcccgcagcgcacccgcggcgagcaactcctcgatctcgccggccacgtcccggcgggccggcgcccggctgccccggttcagcacggccagcgcgaagtcctccgcctcctcacgctgcagacccagccgggccacctcgcgggccaccacgcgcagcttgcccagcccggcggccgggcggaccgcctcggtcagctcccagagcaccagctggtcgagggtgccgtcgccgagcgcggcggccagcgcggtcagcaggttgtcggccgcggtcttccgctcgtcctgtctgcggcgttcggcccggcggcgggccgcgtcgagctgtgccacggtcagcgggcggccgtcgacccgcaggccgcggcgcagggtgaacccggtgagcggcttctcgtcggccagcacgtgcagggagagcggcagcccgagggtgcgcacactgctcagcaccgtgcgggcccgggccggcggggtctccggcagcggccacagctcgtcggcgacccggacccggcgccggcccagcaactcccgcagctgcgcctcgaccgccgccccgcccagcggcgcggccgcgctggccagcgcggcggcggacaccaccgggtcgccggccagctccttgacgatctcgtcgagctgccggccggtctcccgcgcggtgcgttcccgctcggtccggaaatgctcggcggtgagccggtcctgctcgcgcagccgctggtgggcggcgttcagggcatcgacgatcttccggtacgcgatccgctgcgcgcccagcgcctgccaatatttgacgacggtggtgacgtgcgcgtcgaaggcggcaccgcggggcagccgggccgggtcgagcgcgtaccgccggcacaggtcggccggcggggtgttcccgttgcgccgggccgggtccagcacctcatcgcggtaccgctcggcgtcgaacatcgccccggccgccgtcacgccgagacgtggtagcgcgccaccgcgttccgcgccgcggacacctgctcgtcggtcagcccgccccggatctgcacctcgatgtccaggtccttgccggtcttcagctccaccgcgtgcacgcgcagcagcccgtcggccgccatctggaagctgatgtcgatcggcgagccgaccggcaacggcggcaggccgctgatcaggccctcggcgatgtgctcgttgtcctcgacggcgtccgactcgaccgcgccggactgctcccagatctccaccgcgacctcgacctggttcgggtacgcggtgccgaaccggtgcggctcggtctcggccggcagcggcgtgttggcccgcagcacgtgcgtgacggtgaagtgctcacggccgccggacaggtcgaccaccttgaccccgaaggcccgcggcaccaccgtggcgacccgcttgccggccagcgcgcgcaccttctccgccgggatgttcagccgctcggcgacctcgtcgaccacctcggccggggcctcgccgcccgacgcgggcaggtgcaccttgaccgactcgatcaacgcgtaccgcgcggcgcccttggccaccgccaggtcggggtcgtgcatccggggcgtgaggccgagcgactccagcgcggcgctgaccgccggcatccggctcgaaccgccgaccagcagcacgtcgtcgaagtcggtgacaccccgcccggccgcggtctccagggtgcgccgggtgatcgtgacggtgcgctccagcaggtccgaggtgagctcctcgaacttctcccgggacacctcgatctgcgcggtgtccccgccgaaccgggcgttgaaccggcggctctgcatccggctcagctgcttcttgatgtcctcggcgccggccgccagcccctgcaggaactcctcgtcgtcggccgcctccgaaccggggtgctcggccaggaaccgctccagcaggtactccgcgaggcggtcgtcccagtcggcgccgcccaggtggtggtcgccgtcggtgcagacgacctggatctcgtcgggggacacgcggatgacggtggtgtcgaaggtgccgccgcccaggtcgtacacgaacagggtcttcgttcctccggtgttgatcgcgtcgtagtgcagcgcggccgcgaccggctcgtccaccatgctcaacacgttgaggccggcgatctcgccggccttgcgggtggcgtcgcgttcggcgacgccgaaatacgccgggacggtgatcaccacatcccggaccggctcgcccaggctctccgtggcggcgtcggccagctcccgcaggatcagcgcggagatcgactccggggtgtgcgtctgcccgtgcacggtgatctcgaacggccggcccatctgccgcttgatcagtgagaccacctgatccggatggatcttggcgacggccttggcctccttgccgaccaccacgttgtccgggctctcgaaatagacgaccgacggggtggtgtcgtcacccggccggttcttgacgatcgccggccggccggtgtcgtcgatgtgcgcgacgcacgaatacgtcgtgccgaggtcgatgccgaaggtcgccatggggggatcactcgctttcggtgagctcttcgtagcggtagaggcgggcccgggcggcccggcgcacccggccggtctcgatctcgaccaggccggcggcgagcggctcggccacggtccggtcccgcgacggatccgcggtcggcacgccggcgccggccggcgcgtgccgcccggtgacgaacggctcgcccgccaccgcggcgaacacctcatacccgcagcgctccaccgcgagcgtgacatcgtcggcatagctggccagcagtttcgcggcccgcggatcgtcggcggccaggcgccgcgcctcaccggccatcgcgtcgtgcagccgcagcaggtcggtgacgaccggctccaggatcacccggcgcagcccgtcccggaactgccggttctcctcgtgcaaccggtcgatgatcgactcgcggtgcgccgagcggcggtggaaatcggcgagctgcgcctccacccgctccagccgcgccagcaccgggtcggggacctcgtccacgcgccatcgcctcccgtgcgcccgttccggcactgtcagttttggaacgtaacgggtcttcgcgggcggcgctacgcccgggcgcgccgtttcgctacgggaggacgacgcagcggcggcagcgggcctcgtacgtataggtgccgtcgtccggcagcggcgtcgacggggccagctcgcggatgaacggcttgccgtgctccagcacctgggtgtgcgtcgcgtccagcgaccggcacacgtcacacaccgcccggcgatagatcaccttttccggcgccagctcgaacagcgcccgcaccggtgcgaacagctcgccccggtgatccaggtcgatcccggccaccaccaccttgatcccgcgccgcaccgccaccccgagctcggcgatgtcgtccacggtgaacatgtggatctcgtccaccccgatcacctcgacaccgccctccgccgccccggccagcgtgtgcaccttcaatgtgtccaggctgccgccgacccgcgacatcaccgcgctgtcccgcccgtgccgcgccgactggtagatccggtgcgggatgccggtgtgctgcagcggcgacagcaggctgatcatctccagcgacttgccgcccttcatcgggccgaggatcacggtcaggtccatagccgcccagcctgccacccgtcccgcaggacgggtggccgggggttgatcaggcgcagagggcgtcgtcgacggtgccgaggacggcggcggcggcctgctcggtggcgggcatcgtggtgaccgcgacggtggcggcacggccgtccatggtcacgccggtgcgggtctcgtagccggggatgtcaccaccgtggccccacgccaccccgccgcagctgagcgggaagctgaccaggccgaggccgtaccgggcgccgggccacagttcggccgggaccgtcttctccatctcggcgagctgagcgtccggcagcagacggccgtggatcagcgcgctgaagaaggtgttgaggtcggacggggtgccgaccatctggccggccgcccagccccacgacgggtccaggtcggtgatgtcgaagagctgcccgtcggccagcgtcaggtagccctgcggatgccgctcccggatcccggtctcgccgtccgccgggaagtaggtgtggcgcagcccggcgcggcggatcacccgccgggtgatctgctcggccagcggtcgcccggtgaccttctccaccagcaggccggcgacgatgtagttggtgttgctgtacgcccagctcgtcccggccgggaaggtgtccgggtgggccagcgcgaggtcgagcagctcccgcggcgcgaagtgccggtagcgcagggacaggtcgtccagcgccaggtattcggtgtagttggccagcccgctggtgtgctgcaggatctgccggacggtcacccggcggccgtgcagcaggccgggcaggtaccgctcgaccgggtcgtccagccgcacccggtgctcggcgaccagctgcaggacgaccaccgcgacgaacgtcttggtgttgctgcccagccgcacctgcccgtcggcgggcaccggacgcccggtcgcggtgtctccggtcccggcgaccggtctgcggatccggccgtgctcgtcccggacgaccgccagcgcgccggggaagccgtcggcgaccagattcgccagatccttgcggaccgggtcccgggtggcggcgacggcgggctgggcggtgagcagggtggccgcgagaaccgcggcgacgatcttcagcatcggaagctcctggtgatcggtggcgacaccgttcagccttctcgatgcgggacgacgatcccatctggacagcgggccattcgggggtacggctggccatacccccgagtggccgcggacggatcagatgtcgaagcggtccagctccatgaccttgacccacgccttggcgaagtcctggacgaacttctccttggcgtcgtcggccgcgtagacctcggactgggcgcgcaggatcgagttcgacccgaagatcaggtcggcccgggtgccggtccacttcaccgcgccggtggcccggtcgcggccctcgaacagctcgccgtcgctgtcgaccggcgtccagacggtgccgaagtcgagcacgttgacgaagaagtcgttggtcagcgcgccgggcgtggcggtgaacacgccgtgcccggtgtcctggtggttggcgcccagcacgcgcagacctccaaccagcacggtcagctcgggagcggtcagggtgagcagctcggcccggtcgaccagcagctgctcggtcggccggcggtggcccttgcccaggtagttgcggaagccgtcgtgggtgggctccagcaccgcgaacgacgcgacgtcggtctgctcggcggtcgcgtcggtgcggcccggggtgaacggcacctcgacggtgacgccggcgtcggccgccgccttctccaccgcggcggaaccggccagcacgatcaggtcggccagcgagatcggggcgctcagctgcgaccgcagggtctccagcgtgcccaggacgcgggccagccggtcgggctcgttggccgcccagccgttctgcggggcgaggcggatccgggcgccgttcgcgccaccgcgcttgtcggtgccgcggaaggtggaggccgacgcccacgcggtgaagaccaggtcggcgacggtcaggccggaggcgagcacggcggccttgatctcggcgatctgggccgcgccgaccaactcgtggtcgacggccgggaccgggtcctgccagatctgcggctcggccgggacctccgggccgaggtagcgggcgatcggacccatgtcacggtgggtcagcttgaaccacgccttggcgaaggccagccggaactcctccgggttctcgtagaaccggcgggagatcggctcgtagatcgggtcgaaccgcagcgccaggtcggaggtgagcatggtcggcacatgccgcttcgccgggtcgtgcgcgtccggcacggtgccctcggcgtcgggcgaggtcggcacccactgcttggcgccggccgggctctcgctcagggtccactcgtacttgaagagcgtctcgaagaacgtgttgtcccaccgggtgggggtgggcgtccagatgccctccaggccactggtgatcgcgtcgccaccgaccccggtgccgtaggagctcttccacccgctgccgagctgctcgatcggggcggcctcgggctccgggccgacgtgcgaggccgggccggcgccgtgcgtcttgccgaaggtgtgcccgccggcgatcagcgcgacggtctcctcgtcgttcatcgccatccggccgaacgtgtcgcggatgtcgcgggccgaagccagcgggtccgggttgccgttcgggccctccgggttgacgtagatcaggcccatctgcaccgcaccgagcgggctggccagctcgcggtcaccgctgtagcgctcgtcgcccagccaggtgtcctcggagccccagttgacctcttccggctcgtagacgtcggcgcggccaccgccgaagccgaacgtctcgaagcccatcgactccagggccacgttgccggccaggatcatcaggtcggcccaggacaggttcttgccgtacttcttcttgaccggccagagcagcagccgggccttgtccaggttgccgttgtccggccagctgttgagcggggcgaagcgctgctcgccggcgccgccgccaccgcggccgtcgaaggtccggtaggtgccggcgctgtgccaggccatccggatgaacagcgggccgtagtgcccgaagtcggccggccaccagtcctgcgagtcggtcagcagggcggtgatgtcggccttcacggccgccaggtcgaggctggagaacgcctcggcgtagtcgaagtcgccgcccagcgggttgccgacgaccgggttgcggtgcaggacggtcaggtcgagggcgttgggccaccagtcacggttgccccggccgccgtgcgacgcggtcccgtgcgcgaccgggcacttgcccgcgcgttcggcgcggttttctgcggcgagttcgtcagccacggatcctccagagacggcgttcagacccgccgagtctcgccagttttctggagtgagtcaagaaaacatcgggtgatgtaacacctatgcacgggacggcgcatgatccgttgcttgacccggctatggcgcgcgtcacagtgatcggcccggtcgggcagtgtccggataaagatggatgggggaggctttcgtcccacgcgccaacctcgggagcccacatgcccgtcaccaccgcaggccgtctggtggccggggccgccgccgtcttcatcggcgccgccctggtgatcctgagcggttctcttcccgcggacgtcggcaacgccgtctacttcgtgctgccggtcacctggctggcgatctgctgcgggctggccggcatggccctctcccgggtgtgacctgccccctcacaaccgccccggcgccccggtgaggatcgggtaactcgcggcgcactccacagtgacggtgcggtaatcgcggcttcctagcgtgaccgttcgaggacgactcgtcggacggaagggactgcctgtggccgccgatgtcacccaggtgcgcaccgtgtgcggctattgcggcgtcggctgcggcatggtgctcgacgtcgcccgggatgccgccgggcaccgccgggtcctcaaggtgaccggcgacaaggatcacccggccaaccgtggccggctctgcaccaagggtgccaccagcgcggacatgctggcggccgagggccggctgggatacgcgctggtccgtgccgagcgcggcgcggagccggccaagcagccgctggaccgggcgatcgcggagaccgcgcgccggctgcgggagatcgtcgacgagcacggcccggacgccttcgccatgtacgtttccgggcagctgaccctggaggcccagtacctggccaacaagctggtcaagggcttcatcgggaccaacaacatcgagtcgaactcgcggctgtgcatggccagcgcgggcaccggctacaagctgtcgctgggtgcggacgggccacccgggtcgtacgacgatctcgaccacgccgacgtcttcctcgtgatcggcgcgaacatggccgactgccacccgatcctgttcctgcggatgatggaccgggtcaaggccggcgccaggctgatcgtcgtcgacccgcggcgcaccgccaccgccgaccgggccgacctgttcctgcagatccgccccggtaccgacctggcgctgctcaacggcctgctgcacctggtggacaaggacgaagagttcatcgccgcgcacaccgagggctgggcggcgatgccggatctgctggccgactacccgccggagcgggtggccgagctgaccgggatcccggaggcggacatccgcaccgccgccgcgtggatcgacggggcggcgaactgggtgacactgtggaccatggggctgaaccagagcacccacggcacctggaacaccaacgcgatctgcaacctgcacctggccaccggagcgatcagccgcaccggcagcggcccgttctcgctcaccgggcagccgaacgcgatgggcggccgggagatgggctacatgggccccggcctgcccggtcagcggtcggtgctggtcccggccgaccgcgagttcaccgagcggatctgggggctgcccggcggcaccctgcgcaccgaggtgggcaagggcaccgtcgagatgttcgagcggatggccgcggggcggatcagggcctgctggatcatctgcaccaacccggtcgcctcggtcggcaaccgccgcacggtgatcgccgggctggaggcggccgagctggtcatcactcaggacgcgttcgccgacaccgagaccaacgcgtacgccgacatcgctctgccggccgcgatgtggtcggaaaccgacggcatcatgatcaattcggagcgcaacctgacgctggtccacccggtcgtcgacgcacccggcgaggcgatgccggactggatgatcatcgcgcgggtcgccgccgcgatgggctacgcggaggccttctcgtatgccgacgccgcgcagatcttcgaggagatcaaactctttgccaacccgcagaccgggtacgacctgagcggcgtctcctacgagcggctggcgtccggacccgtgcagtggccggccgctcccggtggcccggatcgcaaccccgtcaggtacgcggacttcaccttcgccacggccggcggcagagccgtcttccacgcccgcccgcatctcgatccggccgagctgcccgacgacgactacccgttcgtgctgaacaccggccgcctgcagcaccagtggcacaccctgaccaagaccggcaaggtggccaagctcaacaaactgaacccgggcccgttcgtggagatcaacccggtggacgccgcggcgtacggcatcgccgagggcgaccaggtggagatcgcgtcccggcgcgggcgggccgtgctgcccgcggtgctcaccgaccgggtgctgcccggcacctgtttcgcgccgttccactggaacgacctgttcggcgaatacgtcagcgtgaacgcggtgaccagcgacgcggtcgacccgctcagcttccagccggagctgaaggtgtgcgcggtggcgctgaccagggtcgccgcgccggcgccggccgacatcccggccgggctcgggctcgacctgacaccgccggcgctgagcgaggggcagcggcgatacctggccggattcctggccggtctgccgccggggcgggtgggcgcgccggtgctgccgggcaacgcgccgttcgacccggacaccacgatgtgggtgaacggcttcctggcggggatgttcaccgacgtaccggacaagggtctcgatctgccgcaaccggccgccgggccgcgcctgcaggtcctctgggcctcgcagaccggcaacgccgaggacttcgcgcgcgggctgtccgaacggctggccgcgaccgggcaccagatcaccgtgcgcgggatggacgccgcggccgccgagctgctcgatccgggcgccgacctgctcgtggtgaccagcaccttcggggacggggacgcgccggacaacggggccgcgttctggcagtcgatcgccggggacggcgcgccgcggctggacgggcgccggtacgcggtgctggccttcggcgactcgaactacgacgacttctgcgggcacggccgccggctcgacgaacggctggccgagctgggcggcacccggctggccccgcgcgccgactgcgagccggatttcgaggacaccgcggccggctggctggaatcggtgatcacggcgctgaccgccaaggcggtgaaacaacccaccaaggccgccccgctgccgtccgttctggtcgggaaccgcctgctcagcggcccgggctcggccaaggaggtgcggcggttcaccttcgacaccggcgggctgctcgactatcgggtgggcgacgcgctcggggtgtggccggtcaacgacccggacctggtgcaggagtggctgaccgtgaccggcctgagcccggacaccgcggtggagctcgaccggatcggcatggtcccgctggccgaggcgctcacccggcacctggacatcacgaagatcaccggcgacctgctccggttcaccgccgaggtgggcggcgatccgcacctgaagaccctgctccgcccggacaacaagggcgagctggccaagtgggcctgggggcggcaggctgtcgacctgatcgccgagcagggcgtgcgggccccggcgcaggagtgggccggggtgctcaagcggctgcagccccggctgtactcgatcagctccactccgctgaccgagccggaccgggtcagcctgaccgtgtcggtggtccgcttcgacagcctgagcggccgcccccgcaagggcgtctgctcgacgcatctggccgacgcggccggcgaccgcgaggtgccgctgttcgtgcagaaggccccgcacttccggccgccggccgacccggccacctcgatgatcatggtgggtccgggcaccggggtggcaccgttcctcggcttccttcaggagcggcaggccaccggggcgtccggtgccaactggctgttcttcggcgagcagcgccgggagaccgacttctactaccgggaggagctggccgcgctctccgcggccggcaccctcagccggctcgacctggccttctcccgggaccagcgggccaagatctacgtgcaggaccggatgcgggagcagggcgcccagctgtgggcctggctcgccgagggcgcccacttctacgtctgtggagacgccagccggatggccaaggacgtcgacaaggcgctgcacgagatcgcggtcaaccacggccggctgtccccggaggcggccaccgcgtatctcaagcagctggccgccgacaaacgctacgtccgcgacgtgtactgaccagcagcaggaccacgtcagtgggcgacggcagggccacggctcgcatcaacgccgaccctggccggtttgaggaggcgctccggccactcagtggtgacgacccggggccggtcgagtgatcgacgggcccgccggcctgagggctcagcgcatcaggggtgccggatcggtgacgagcaggtcgccatggcagcgcagtggcggcagccgctcgctgaacggcagggtcgtgcggtaacgcggcgtacctgccggcctgccccgaaaggggcgtccgatcggggcgatcttgtcgcgtcggttccgacgtggctgcggccttgtctcgacatgggcgtcggccttacgctgccaacagcaggaaagcgctttcctcaaactcggaggtaaccgtacatggcagcgcggagatcgatcggcatcgtcgtcaacggagtgaccgggcggatgggttaccggcagcatctggtccggtcgctgctcgcgatccgggagcagggcggcgtgccgctgcccggcggcgggcacatctggcccgagccgatcctggtcggccgggacccggaccggctggccgcgatcgccgcccggcacggcctggccgagtggaccaccgacctggccgccgcgctcgcccgaccggacgccgagatctacttcgacgcgcaggtcacccagcagcgggagaaggcgatccgccaggcgatcgcggccggcaggcacgtctacaccgagaagccgctggccgagagctccgaggcggccgaggagctggctgagctggccaccgccgccggcattcgccacggtgtggtgcaggacaaactgttcctgcccggcctgcgcaagctgaagcggctgatcgacggcggtttcttcggccggatcctgtcggtgcgcggcgagttcggctactgggtgttcgagggcgactggcagcccgctcagcgccccagctggaactaccggctggccgacggcggcggcatcgtgatggacatgttcccacactggaactacgtgctggaggagctgttcggcacggtccgcggggtgcagacgacgatcgcgacgcacgtgacgcggcgggtcgacgagcgcggcgaggagtacaccgcggacgccgacgacgccgcctacgcgatcttcgagctggcgggcggcatcgtcgcccagatcaactcgtcgtgggcggtccgggtcaaccgggacgagctggtcgagttccaggtcgacggcacgcacggcagcgcggtcgccggcctgcgcggctgcaagatccagcaccgggcgacgacgccgaagccggtgtggaacccggacctgccgctgaccggccggtcgttccgcgacgagtgggccgaggtgccggacaacgacgagttcgacaacgggttcaaggtgcagtgggaggcgttcctgcggcacgtcgtcgccggcgagagcttcccgtgggacttcgcgtccggtgcccgcggggtccggctggccgaggcggggctgcggtcggcgcgcgaggggcgccggatcacgctgggcgacgcctgatggccaccgtcgacctgcccaccgggcggctgaccctttccggtcactcgcccttccccgcggcgccggtgcccgcggcgcgcagccggatcgcgtacgccgctgcccatgtcgtcgcggacccgcgcgcggagaacgccccgggtgcgcccgccgccctcgactgggccgccaccctggccttccgtcggcacctgtgggcccacggcctgggggtcgccgaggcgatggacaccgcgcagcgcggaatgggcctggattacacggccaccagggagctcatccggcgcagcgcggccgaggccgcggcctgcggcggccggatcgtggcgggggttgcgaccgatcaattgccgccaggttcgccgtcgctcgaaaaaatccgatgggcgtacgacgatcagctcgcgttcgtgctcgacgccggcgccgtgccggtgttgatgtgcagccggcacctggccgccgccgcgcgggacgccgacgactacctgacgatctatcgcgccctgctcgacagcacgagcactccggtcgtgctgcactggctcggcaccgcgttcgatccggcgctggcgggttactggggctcgtccgacgtggacaaggccaccgaaaccgtgctggagctgatcaacagcaaccccggcagggtcgacggcatcaagatctcgctgctcgacgccgatcacgagatccggctgcgccgccggctgcccgccggggtccgcctctacaccggcgacgacttcaactatccgcagctgatccgcggcgacgaccgggggcactcggacgccctgctcggcatcttcgcggcgatcgccccggccgcggccgccgccctcgccgccctggaccggggtgacctcgacgggtacgaccggatcttcgcgccgaccgtgccgctgtcccggcacatcttcgagaagcccaccttctactacaagacgggcatcgtcttcctggcctggctggccgggcaccagtcgcacttcaccatggtcggcggtctgcagtcgggccggtcggtgccgcacttcgcccgcctgatcgctctcgccgacgcggccgggctgctgcccgacccggacctggcggcccaccgggccaaccgattcttcgaggtgatggccggatgagccggttctcgttcaatcagatcaccgcccggtcgtgggacctgccggacctggtcgccgggtgcgtcgaggccggcgtcggacaggtcgcgctgtggcgcgagccggtcgccgaatacgggttggaacgctccgcggccctggtccgcgaggccggattgaccgtcaccacgctctgccgcagcggcttcttccaggagccggactggttcgacgacaaccgccgggcgatcgacgaggccgccgcgctcggcaccaccgtgctggtcctggtctccggcggcctgccggacggatcccgggacctggccggggcgcgccggcacgtgggcgacgcgatcgcccggctggtcccgcacgcggccgcggccggggtgaccctggcgatcgagccgctgcacccgatgtacgccgccgaccgctgcgtgatcaacacctgggaccaggccgtggcgatcgccgaacagcaccccgccgggcaggtcggggtcgccgtcgacacgtaccacctctggtgggacgacacggtgctggacaagatcgcggaggccggtgagcggatcgcgatctaccagctggccgactggatcacaccgctgccggccggggtgctgaccggccgggggctgcccggagacggctgcgtggacatgcgggccttccacgaggcggtggacagggccggatatgccgggccgatcgaggtcgaggtgatgaacgccgacctctgggaacggccggggcgagaggtgctctgggcggcgctcacggcgtacgaaagtgtgtttcagaggtccttgtgaagccgggaccggtgcggccgacgatgtccgggccggtcccttccacctttctcctcgtgctgtttcggcggcagggagccggcgaaatccacgccggcgcgcagccatcgggccaggtcctcgtcgtccaggcgggcgccgtcgacgacgatccagttccgcatcgggcgaccggtgaaatcgaagacgcgggtgccgggctcggcgagggccggtgcgacggctggtgcgccgaggcggacgatcagatcgtcgcccatcacgccggccgccatgttgccgtggaccagaaaggtgatgccgccgaacatccgtttgccggtcaccccgtcgacgtcgccgagctgatcccggatccgttccgcgagtacctcgtcaaaggccatgcgatcaccgtacgcccgcagccgcggccgccttagatgtgactcacgtcacgctggctcgaaaaccggaggccgcttggcgtcgtcttgcctgttgtgaaacgaagtctggacgcggtcgacgaggcggagctcgtgcgccgcaccgccgccggtgaccggcacgcgttcgacgagctctatcgccgcacgtcgccgtggctcgccgtgcggctgcgacgccgctgctccgaccaggacgtgatcgccgacgtcatgcaggagacctatctggccgtctggcgggccgccggcgacttcgccggcacgaccgtcgccggcagcgcggccggctggctctggaccatcgcggcgaacagactggtcgacgccttccggcgccgcgcccgccagcagcaggcgcccaccttcgtgcccgagcccgcgcccgccgcggaggacgaggtgatggccggccgggtcggccaggagctggagcaggcgctgctcaccctcccggccgaggtccggcaggtgctgcgcgccatggttctcgacggcctctcggtccgggagacgtccgtgctgctcggcgtgcctgagggcaccgtcaaatcgcgggcgcggcgcgcccggatcgcactgcgggaggcgctgtcatgaccgggcacccgagcccctcggtgatctcccgatacgccgacggcgacctgagcctcgacgaggccacggtctggacggtcgaggtgcacctcgaggagtgcgccgactgccggacacggctgtccggtgcggtgccggccgacgtcctgatcctgctcgaccgggtgagcaacggggtggatcagggcatcgcgtcgggtccgccgccgatcccgctgcggcgacgacgctggtcggcggcgcggcaccggtggctggtctggcacctgctgccgtggctcggcatgaccgcggcggccctcggctgcgcggtggtgctccaggcgctcgcacccaccctgccgtcgctggtgctgctgctggccccgatcgccccgctgcccggggtggcggtcgcctggagtcggggcgccgacccggcctgggagctgatcgccagcaccccggcggccgggctgcccctgctgctgcgccgcaccgcgacggtcctggcggtgatcgtgccggtgctggccctgatcagcaacggcgtcggcgtctcgctggccctgaccctgctgccgtgcctggccttcacgaccacggcgatcgcgctgggcgccgtcctgggcgtccgcctcgccgcgatcagcctggccagtgcctgggtggcgatcgtcgccgtccccgccgtgttcgtgatgcacctcccggcgatcctgctcccgggcagcgtcgcgatctgggtgtcgaccatcgtcgtggcggccgctttcacgctgagccccgccatccgctcccgccggttctcccgatgagccgcaccgatctcttccaccggttgttctgatgagccgcaccgacctttcccggcggttcttccgatgagccgcaccgacctttccgaccggttcttccgatgagcggtgcctgtttccgctggatcttccgatgagtcgcatcgatcgccgtcgggcggtcgtgagtgacctctgtgcttcgctgcccgggttgccgggcggcgctattcgaagggacatcgcatgcgtacggtgagcgcggctgagaccgcccccaccctccatccctgggtggtgcaggccgagggcctgcgcgtccgcgccggccggcatctggctgtcaacggcctcgacctcgcgctcggcggcggcgtccacggcctgctcgggcccaacggcgccggcaagacgacgctgatgcgcgccctggccacggtgatcgagccggccggcgggcagctgaccctgctcggcgagtccgtcgacggccgcgccgacctgcgccgggtgcggcgcgggctgggctatctgccgcaggccttcgggttctatccgcgcttcaccgtgcgcgagttcgtggagtacatggcctggctcaaggagatgccgaaaccggcggtgccgggcgcggtccagcgggcgatcgagcgggtcggtctcgccgaccgggccgaccgccggatgaaaacgctgtccggcggcatgctgcgccgggccggcatcgcccaggcgatcgtcaacgacccggcggtgctgctgctcgacgagccgaccgtcggcctggacccggagcagcgcctcgacttccgcgagctactgcgcgacctgggcaccgacagctgcgtcctggtctccacccacctggtcgaggacgtggtcgccgcctgcaccgacgtcgtgatgatcagcgagggccggctggtgttccagggcaccccggagtcgctgatcgcccagggcggtcccgacgacgcgggtgacagccccgccgagcgaggctattccgcgctgctgcgccgccaccgttcggaggccgcccggtgacccgcatcctcggcatcgagctgcgtcgttcggccgcgctcggctccgtcctgatcctgaccgcgatcggcgtcgccctcatgttctacttcgaggaggccgactggaccaccggctgggtccagatggtcatgtccgagcggctctacctggcgctgctctggccgctgtccctggccgccggcgcctggcagggccgccgcgagtcccagtccaacgtggccgagctgttcgccagcaccccgcgcccgcgcgctcagcgtgccgcgccgaccctcgccgtgatggccctggccgtcgtcaccagctacctgctgatcgccctcgccgccggcacgaccctgatcggccgggccggctacttcccggcggccgtgccggccatcgccgcggtcggcgccctgtcgatgctcgccggcgcctggttcggcctcgccgtcggccgtctgctcccctggctgatcaccgcgcccgccctggccgtcgccggtctcgggctgctgctcggcctgccctccaccagccggcaccggggctggctggccaccatcttctcgccgatcttcgacatgaacatgccggacaaatactcgaccgtgcccggccgggccagcgtctcgcaggcgatctggatgatcacgttcgccgtcaccggtgcgctcctgttcgccgcggccggctggcgcacccgggtcgctgccctgctcccggtcgctctcggcgcggcggtggcgatcgcggtcatcccgcaccaggaccggctcatcgtggactcggtcgacccggtcgccaaagagctggtctgcgcccgcaacgagccccgggtctgtgtcagccgggtgcacgccggcctgctgcccgagctgctcccgcaggcccgcgaggcgctgaccaccctggcgaaactgcccggcaccccgacccgggtgcacgaggacaacagcacctacgtcccggacgttcccgcgccgaaaagtccggacgtcgccctgatccgcatcgacgtgaacaagagcggccacctggacaccgacctggcaccgcggatcgtcgccgcggccttcagcggacggcccgactgcgacggctccccgcgccaggcggagacgctggccgcggcgtactggctgatcggccgtgctccggcgatgctcgccgacttccaggacgagcaggacaccgccaacgccgccgccgagtggcagagactgcacgctctgcccgccgacaaggccactgcccaggtgatcgccatccgcgccgccgccacgaggtgcgagtgatgccgcgcgcctcgtcgccgctcacggcgggcagcccggcccggcgtcggctgatgccttcgctgggcgcggccggcctgtcctcccgctggctgatgctctacctgcgttcacggcgggcgcccttggcgctcgccctggtcggagccggcacggtgctgctgtggattctgtgggtcaccacgtccaagacccgcgacgtcgactgccggatggtgcaggtcgcggtgctgctcgcggtcgcggccctgaccgccaccctgggcgcgcccgacgacgcactggaacgcaccggcgcggtcaactggccactccgccggaccgtgcacctgctggtcgccctgctgatcgtggtcggcctgctgaccgtcacgctgctcaccccggcccgcttcggccctgcgagcttcgtcctgcgcgacgcggccggactgctcggcctcaccgccctcggcgccgcctcgatcggcccggcccgctcctggttcgcaccgctcggctggaccttgacggccgtcatgttcccgctgggcgacggcaccatccagcagatcgtcacctggcaggcgcagccctcgggcaatgctcccgccacggtcacggctttgctgctggccctcggcggcctggtggcctatgccaacgccggcccgtcccggagagcacccgccgaggtcccggtctagacagctaccccgtcgtgtcccgtcggaccgaacgcacccgccccgactcgacgggtccgttcggtcaggcgggtccgtttcgtcgggcgggtccgttcggtttggcgggtgcacttggttcggcgggttggtttcgtcgggcgggtgcgcttggtccggcgggtccgttcggtcggacgggtctgttcagcggagttcgttcggatcggcaggcctgaccggctgccgggtccggctcacccgcctgctccatcctgccttgctcggcgggcggctggcccgcctcgactcgcctttcgcaggtcatcgcccttcccggcggcggcttgttctcacgggggcccggcttggctgccgtcgaccgtcgtgggtgatcggccgctgggcgggggagcgcgccggcggtgggtgacatgtgccggacggaggcggaaggggttccgggggcgagcaggtggagattgggataggaatcaagggtgacttcctatgcggcggcggccgctcgttatgacgccatggaatatcgccggtgtgggcgcagcgggttgaagctgccggcgatctcgctcgggctgtggcacaacttcggggacgacaagccgatcgagacgcagcgggcggtgctgcgccgggccttcgacctcggtgtcacgcacttcgacctggccaacaactatgggccgccatacgggtcggcggagatcaactttgggcggctgctggccgaggatttccggtcgtatcgggatgagctgatcatttcgaccaaggccgggtatgacatgtggcccgggccgtatggggaccgtggatcgcggaagtatctgaccgcgtcgctggaccagtcgctgcggcggatgggtctggactatgtggacatcttctactcgcaccggttcgacccggagacaccgctcgaagagacgatgggggcgctggacgcggcggtgcgggccggcaaggcgctctacgtcgggatttcgtcctactcgcccgggaagaccgcggaggcggcggcgatcctgcgggaactgggtacgccgttgctgatccaccagccgtcgtattcgatgctgaaccggtgggtcgaggaggatctgctcggtgtgctggagcgggaaggggccgggtgcatcgggttctcgccgctggcgcagggcatgctcaccgaccgctacctgaacggggtgcccgagggttcccgggccggcgaacaaaaatcgttgacgaccgactggctcaacgacgagaacctgggcaagatccgggcgctgaacgcgatcgctgaacggcgtgggcagagcctggcgcagctggcgatcgcctgggcgctgcgggatccgcggatgacgtcggtggtgctcggcgccagcagcgtggcgcagctggagaacaatctcgcggcgctgggcaacaccgcgttcgccgcggacgaactggccgagatcgacaagtatgcgaccgagtccggcatcaacctgtgggcgcgctcgagcgattactgaccggcccgccgccgccgaacgcgatccagcgtgcggggcggcagccggagcgccggatggtgccgcgtggcgccgaggatggtcgcgcggtgccacggtgggtcgcgcggtgccacggtgggtcgcgcggtgccacggtgggtcgcgcggtgccacggtgggtcgcgcggtgccacggtgggtggcgcggtgccacggtggtcgcgaggtgcggactgctcgctctaacgcttctgcgagcgcaactccaccagcaggccgtcgcggtcggtgagcaccgcgccgaggatgcggcgtcccgcggcgagcaggtcggcgacatccggggtgctcaacgcgtacatcaccagggcgccctcgcggaacgaggcgacgatgccggcgcggcgcaggacggcgagctgctgggagaggttcgaggcctccacgtcgatctcggctagcaggtcgcggaccgggcgcgggccgtcctgcagcaactccaggacccggatccggacggggtggccgagtgtccggaacatctcggccttcgcctgatacagcggcacggacacggcgggtcccctccagtcattcacaccgaccaacgcgggggaggcggcccggttacgtgccttgtgcagtttcgaagttgcagaaatcttcaactgcccggccgccaggaaaagcatcgcgggtagtcgactgtccaagccggacatcatgtgcgacggggttgccgccgggtcggtgacagtcgatgtcgaccggagcgagacatcggaggagaccggatgccggacatggacgtagccctcaaggacgcgatgcagatcgacggcgccatcggcgtcgctctggtcgaccgcagcagtggaatggccctcggtgtcgccggcggcgaccggaatttcgatctgaccgtggcggccgccgccaacaccgaggtcgtccgggccaagctgcgcaccatggagatgctcggcctgcgcgagaacatcgaggacgtgctgatcacgctggagtcgcagtaccacctgatccggccgctgaccgggcggtcgggccagggcctcttcctctacctggcgctgcacaaggagcgggccaacctcgcgctggcccgccaccagctcaaacggatcgagacgaatctggatatttagcgaaccactcgtcggagaggatcgcgaagtcgacctcggtgctccactcgcccttgaacagctcgttgtgcacgagccgggcctcctgccgcatgccgaggcggcgcagcacccgggcggacggctcgttgcgctcgtcgatccgcccgatgatccggtgcaggccgagctcctcgaagccgagccggagcatggcctgggcggcctcggtggcgtagccctggccgaccgcgtcggggctcagcacatagccgacctcgccgccgcggtgccggcggctgtgccagaacaggatcacgtcgccgaccagccggccggtctcggcgtgctcgatgcccagggtcagcgactgcccctcgtcggtgaggaccgtcgcggcccagtaggtcgcgagccggtcagcgatgacctcgggggtcatcggctcgaacggcaggtagcggcagacgtcggggcggctgcggtaggagagcagcgcctcggtgtccgcctcggtcagcgggcgcagcaggagacgctcggtcgtgatcggatacgcgggacgcaactcgttgggcgacacgcgaacatcttgccatccgcgtgccgccgttcgcacacacgttcgagttatccacaggctgtgtgcacagcctgtgggttcagcggcgggcgtccgcgtagcggagcagcgcggcgacaccgccgcgcaggtcgtgctcgtccgggtcgcagagcaggatcgacgcgtcggtggcggccagcgcgcgcagcatcgcggcgtccgcccggaccagcggcgggtgcgccgccccggccgagcgcagttcctccgggtcgtcgctgagctggtgcgggtcggggccgatccacagccgctcggtggacgacggatcgtcgatcatcagcagcgtgtccacctgcccccgcgacaggtagctcaccacctcggacaggccgttgccggccgagccgtcgtgcgccagctgggcgtgcagccgagcgagcgtgtcgcgccgcagcgcctcggcgcagtccgtcatcgcctgcaccgggacggcgttctcggtctccaccacccgttcgcgccaccggtccggaagctgggtgacgagccgggggcgggcctgcggggcgccggccaccaggatcagctccgggccggtgcggtcggccagctcggtgaccgcgtcggccgggtcgccggcaccggcccgccaggtcaggtcggtcaacggcggggaccatccgccgcccgggatcagccggccggtggcggccgcgtcgatcgccgtgccggacggggcgacggccacccgcaggtagtggatctcgccggccaactgggcgaccatcggcatggcgtcggggagtggctcgtacgccgaaatcgtcgtggccggcggcgcgtgcagcgcctgccgcaggatcacctcccccgcggtggcgaacagcgcgagtccgtgccgcccgggccgggccggatgatcgaggaccgcgtcctccagcgcgtgcacggtgagcgggtcgcaaccggcctcggcgaggatctcccgggccgcgtgccagcgctgctcgatcagccgcgcggcgtccgcggtgtcccgcgacgtgtcgagatataccgaagcccacggtccggggcgttcgtacaaccggcggagcatggtgagtcgcatgggtctggcctccctgtgtcccgagcgtgcaggtccctgccagtttcccccgccgagcggcctcagccggggcgtttgcggttcagcagggcccaggcgccgggcagcagggcggtggcgagggcgattttgagcgcgtcgcccatcaggtaggggaccaggccgtggcagaacgcgccgggcacgtccatcgtggtcatcagggccagccagggaacgccgaacaggtagatcagaagatttccgatcaacatcagaccgatggtgtacgccggtcggcgatccgccccgagcgccgcgagctgcccgaccagcgccgccgccacgatgaagccgatgaggtatccgccggtggcgaccggccaccccgaggtgccaccggcgaaccagggcacgcccagcaccccggccagcgcgtagagcaccatgccggcggcgccgcggcccgggccgagcaccgccccggccagcagcaccgcgaacgtctgcccggtgatcggcaccggcgagccgggcaccgggacggcgatctgtgcggcggcgcccaccgcgccggcggcgcccacgatcagcaggaggtcgcggacggcggaccggccccagacgtcggcgagcaccccggtcggccggccgggcaccaccgcaccgaatacgtcagtcatgggtgacctcccgtccagcgttgcgggaaccgtaagcgtcgaagatcacggtcaggcgtcactgtggccggtatcgcaccacatcggaccacgcgaggggcgctgccgggtggcagcgcccctcacgtcgatcggtcgagggatcagacggtcagggtccagctgttgatgtagccggtgtcctgggagtagacgtcctggaccctgaggcgccaggtgccgttcgccgcctcgctggacaggttcttggtgtaggtggtgatcacgttgtcggcgctgtcgctgccggacgtggccttcaggttgtagaccgtgccgtccggggcgaccaggtcgacccgcaggtcaccgcggtaggtgtggacgatgttgaccgcgatggtggaggtcgccgaggcgctgcgggcgcagccgctgatcacgatgttgctgtagaccgcggcacccgcgtccgggatcgagacgtcggtgtcgttggtggcgctgcagccgcccggcggggtggtcgtgctggtcgacgggctcggggaaccggtgccgccgccggagcaggtcgggtcggcggactgggccggcacgttgaccgcgtcccacgccgccttggtggtgttgaacaggccgcagctcgagtccagcgccttggccgcggtcagcgtccaggtgcggtacttcaggtacgacgagctggaggtcttcatcagcatcgcgttgtacatgatcttgatggcgttctggatgccgacgccgctgatcgcgccggagccggagcaccgggtgctggtgggctggccgtcggtcgggttggtgccctcggcgagcaggtagaaccagtggttgccggggccggccgcggcgtgcacctcttcgctcgggatgctgctggagtagcagttgtcgtcaccggcgagcgacgggttgtacatgtaccggatcggaccgctgccgaccaggttgacctcctcgccgacctggaagtccggcgggtcgttcgggttgttggcgaaccactcggtcgacgcgccgaaggtgtcggcgacgaactcctgggtgttgccgttcgagatgccacccggggtgttgtcgtcgatgccgtggcccagctcgtggccgaccacgtcggcggaggcgatccactgaccggcggtgttcttgccgatctggacctggctgccgtcgtagtaggcgttctggtcgttcaggccgacccgcaggggccagccgccaccgctgccgttgaagccgttgcggcccagccaggtggacagcatggccttctcccgctgcgcgacgtagagggcgtccgcacagccggtctcccggttggtgccggtgccgttgccccacacgttgtcggagccggtgaacgtggtgttggacgccgcgtcctggcacttcagggtggtcatggtcgggtcggtcatgctgtacgtggagccggagagcgtggtgtccaaactcaccgtgccgttgatccagccgttgccggtgccggtcacgtcggtgacgtgctcatgggtccgcagcacccggccggtggcggcgtccacgtcgacggtgagccggctcggcccgccggcgttcgtgccccggatcgtggattcccaggccagggccggggtgccggtggtggccagcacgacgagacgggtgccttcgacggtggtgaccgtcttcagctgacccttggcgaccttgagggaggcggccgcggtcagcgccggggtggtgttgaccgcgccgagcggcgagctctgcgccgtcgacgtgaacttgacctggccggccaggtcggtgacgacgacaccgtcaccgccgatcaccgggaggcccttgtaggtcttgtcgaacggcacgtactggaggtggtcggtggagatcacgtcatgctggacgaaggcctcgtcggcggccgcgtgcagggcggcggggcgggccgcgaacagggatgaggcggccgatgcggccgcggcggcgggagaggcggccacgttgggctgggcggtcgccggaccggcgaccgccaccgccaccgaggcgaccgctgttgcggcgaccgcggcgacgacgacaggggtacgggatttcacgcactgctcctttcccgcccggggggttggcgggcgggctagaccgtccgtggacgatgggtcacgtctcgatgacttgtggtgagacgttaagcatcgacgaacgtcaccgaatcagggaaaaccctcgttcagttcggagagcgctatctatccggtagctgctaggagccgatctcgtcgacctgcgcataaggcgcgttgttgtaccagatggcgtggatgatgaagctgtgcgcggtctcgttgaagtagaccgccatgtcgcccggcgagctctgcgtcttctccaccgcgtacccgtccgccggcgtcgcggtgaccagggagacgacgccctcgctggtcatcctgatgaccgcctggccgcccttgagactgaaggagcggacgtacgtccggaccccggcaccgtcggtggtcaccgtccacccgttctcgttggtggtggacggcttgccggtggggacggccgccggtgatttcgacggcttcctgctcggcttcgcggacggcgacgtgggtgcgggcgccggcgtcgtcggggtcaccgcgggggatggcagaggggtccgcacgtcggcggccggcacctgatcgatctcgggcagcgccccggcatcggcccgggccgcattcagcaccgggagcagcgccacccaggagagcacgatgctggtcgcggtagccacgaaccagcccgccaccggaacccaccgggaagatcgcacgacgcccatcctctcacctggtcctatggtgtacgccatggcgttgatcctgttggtcgaggacgaccgcaacatcgcggccgcactgacccgtgcgctgaccgatgccgggcacgtggtgcgtgccgtcggccaagccgcccaggcgctgaaaatcgtcacccaggaacggcccgacctggtcatcctcgacctcgggctgcccgacatcgacggcaccgacgcgctgcggatgatgcgcaccgtctccgacgtgccggtcatcgtggcgaccgcccggcgctcggaggcggacatcatcgcactgctcagcgccggcgccgacgactacgtgaccaagccgttctccggcgggcacattctggcccggatctcggcggtgctgcgccgcgcgcggaccaccaccgagcaggcgccgaatgcgatcaccgtgggcgagctggtgatcaagccacggcagcgccgcgccgagctgcgcggtgagccgctgcagctgacccgccgcgagttcgacgtgctggcctacctggccgaacgggtcggccaggtgatcagccggcgggagctgatgaaccaggtgtggaaccaggcccggatcggcgaggagcagaccatcgacgtgcacatctcctggctgcgccgcaagctcggggagaccgccgccaaaccgcggttcctgcacaccgtccgcggtgtcggcgtgatgatggtcgacccgcagtgaggtgggcgctgaaccgcctcgccctggccatcacctcgatggtggccctggcgttcctggtcccgctggccgtggcgatctggcagatcgcccacgacaaggccgtctccgaggcgcggcagcaggccacctcgatggtgaccgtgctcggcgtcaacgccgacccgaccgcgctcaccaacgcggtggccagcacctccgccggaagcgccgggctgctcgccgtgcaccttccgggcctcgacccgatcggcacctcgcatctgaccgcgacgaccgtcgagagcgccgcgaaacagcgccgctccgggaccgtggcggccgccggcggagtcgcctacctgcagcccaccgtgctcaccgacggccggaccgtggtggtcgaggtgttcgtcaccgacgacgagatgcgccgcggcgtctggtccgcgtggctggccctcggcggcctggccgtgctgctggtcggcggttccacgctgctcgccgaccggctcggcgcccagctcgtccgggccacccggcagctcgccgcctcgacccgccggctcggcgccggcgagctcggcgaacgcatcgagccgaccggcccgcgcgagctgcgcgacgccgggcaggccttcaacacgatggccggcgacctgcgccggctcctggaccgcgaacgcgaactcgccgcggacctctcgcaccgcctgcggacgccgttgaccgcgctccgcctcgacgccgaagccattccccccggcccgatcgccgaccggatgcgcgacgcgtgcgacctgctcgacgaggaactcgacgcgatcatcaacggcgcccgcctgggcgtcgaggaacgcggcaaggagcagtgcgacctggtcgaggtgctggccgaccggctggccttctggtcggtgctggccgaggatcaggaacgcccctgggaggtggtcggcgggcacgaaccggtgccgatcccgctgtcgatgagcgacgtgatcctggtggtcgacgcgatgctcggcaacgtcttctcgcacaccgacgagggggtggccttccgggtcagcgtctcctccaccggcttgctggtcgacgatgcggggccggggatcgacgacccggaagcggcggtacgacgagggcacagcggcgccgggtcgaccgggctgggactcgacatcgtgcggcgtgccgctgacaacgtacgcggtcaattgatcgtcgggcgaagcccgttgggtggagcccgcgtcggattgctgctcacgtctcccgccgggtcttgaggcgggttttcggtctccttaaggctgcgttatggcagctctccctaatgtttcgcccggtaagagagccaggacgaaatgtctggagaccgacatgcgcaggaagatcgcctacccgctggccatcctcgggatggccggatcgaccctggtgatcacctcaccggctctggcccacggctacgtctcgtcgcccccgagccggcaggcccagtgcgcggccggcacggtcgcggactgcggcgcgatccggttcgagccgcagagcgtcgaggctccgaagggttcccgggaatgcaacggtggcaaggccgactacacggtcttgaccgacgactcgcgcggctgggcggcgacctccgtcggcacctcggtgaagttcagctgggtgctgaccgcccggcaccggacagcgagctgggtctactacgtggacggtaccgcggtcgccacgttcgacgacgggaacgcgatccccgaggccacggtcagccacacggtgaacctcggcaggtttccggggcggcacacggtgctggccgtgtggaacatcgcggacacggcgaacgccttctacaactgcgtggatctgaacatcggcggcggagctccgtccacgccggcgcccacgccgacggccgcgcccacgccgacggcggcgcccaccaccgcggctccgaccaccgcgccgaccgcgaccagcgctcccgcctcttcggccggcagcggtacgaagtgggcgccgggcgtcagctacaaagccggtgacgtggtgacctatcagggtgtctcgtaccggtgccgccagccgcacacgtcgatccacagctgggagccgtccgggttcactctcgccctctggctgccgctgtgaggcgccacgtcgtggccggcgcgctgctcctctcgctggcggcatgcggaacagcgccgtccgcccccgccccctcgaccccctcggcttccgcggcggccgccggcgcgaccttcaacgcccgggacgtgatgttcctgcagatgatggtcgaccaccagcagcaggggctgcggctggccgcgatcggcgccggccgggccagccgcccggacgtcgccaacctggcccgggccgtcgacctcaccgagaccgacgagctcaccatgatgaagagctggctcaccggatggggtaggtccacccaggtggacaagcgggtgagcgtgcacgccgaccacggtggtctgccgagcaccaccgacgccgagatcgagtcgttgaagacggtgaagaaggcggacttcgagaccgcgttcctcaacctgttcctggcgcaccagcacaacgccgtggagatggcgcagctggagctggacaccggcgcgaacgagcagaccaggcagttcgcggagcgggtcaaggaatcccgcgccgaccaggtccagcagatgctccgcctgttgaacggttgatctccatctaacggatggctcgtctggcgggcgggccatccgttagtgacgtatttttcctgatatgcaggttatggcgggtcttctggtcggcgccctcctcgtcgcgcccacctgggaccatcccggatacgacgccgaggacagctacttcaacccgtccgcgatcgccgtccggcagctcactccgacctggtcggcgagcctgcgccaggtcgacgaaagctgctcgggcttctccgccccgatcgtcggcgacgaccaggtctacgtcaccgaccgcgagggcgtctcgagttacggcctcgacttcggcgacctgcggatccgcttcacgtgggattacgcgtacgacaacagcacgccgcggatggccctcgccggcggcctgctgatcctcgccgacgacgactgcaattcggcgagcgccccgcacggccggctgaccgccctcgacccggccaccggccggccccgctgggaccacaccgtcggcccgatcgtctcggcgctggtcgacaagaacgtgatcctggtgtccgggtcgtcgccgtccgacgagcagtccgtcgccgcctatcgggtcagcgacggccacctgctgtggagccgggtcgactacgcctccagcggcgtctcggcgaacggcgtcgtcccgctggagaagggcgacacgaccatcgcggtgggcgtgtccaccggaacggtgcgctggtcgcgaccgtcgccggcccgggtgcaggcggcgagcccgcacgcggaccgcttctacgccaccgacggatcgggcgcgctgctggcgctggacgccgccaccgggcgcacggtgtggacggcggccggtcgggccagcacgctggtcgccgccgacgggacccgcgtctacctcgcctccggctcgacggtgacggcgctcagcgcggccaccggccgggtggtgtggtcccgcaagctgtccgcggcggccggccagccggtggtggcggccggcgtcgtctacaccggcagccggatcctgaacgcggccaccggtgtgcccaccggccggacgctcgccggcctcgtcacgccggccggcgaccgcctctaccaggtcgacggcgcgcgcctgaccgcgtacggcccggttgcctagtgcccgggttccccacggtccggttcgatagcgtggacgtgcacgccaaccggccacagacataggggaacacgtggagctgctgcactccggcaaggttcgggacgtctatgcggacgggggcgacctcatcctggtcgcgtcggatcggatctcgatctacgacgtgattctgccgaccccgatcccggacaagggaaagatcctcacgcagctgtcgctgtggtggttcgaccagctcagcgacatcgtgccgaaccacgtgatctcctcgacggatgtgccgcaggagtgggcggggcgggccatccggtgccggcggctggacatggtggcggtggagtgcatcgcccgggggtatctggccggctcggggctcaaggactatcagcgggacgccgccgtctccggggtgccgctgccgccggggctggtcgagggatcgcggctcccggagccgatcttcacgcccagcaccaaggaggcggtcggcgccgggcatgaccagccgatgaccttcgagcaggtggtggagcaggtcggtaaggaccaggcggaggagctgcggcggatcaccctggagatctaccgccgggggtcggagatcgcggccggcaaggggatcctgatcgcggacaccaagatcgagctggggctggcggacggtgagctgatcctcggggacgaggtgctgacgccggactcgtcgcggttctgggcgaccgaggagtgggcgcccggcgacgtgcagcggtatctggacaagcaggtgctgcgggactgggcgacccgggagaccgactgggaccggaccgagccggggccggacctgccggagcacgtggtgcaggcgacccgagggcggtatgtcgaggtttacgagcggctgaccggggaccgctggagctagtcagacggtgggccggcggtcggtggacgacggccacgacggggcgtccgccgcccggcggcgtttgcgcagcagccatccgccgtacgcggcggccagcaccgcttccagggcgcccgtccagccgccgtagagcaggcagatcggggcgatcgtccacagcaggatggtcaggatcaaccagcgccggcgttgccgggggtgtatccggtcgacccggcgggtaaagcccgggtcggcgtcccgcaagcgggccaccatgccgtcgaattcccgctcttcccgcggctcgagcacgccccgtcacctccatagcgaggatggacggatcgaaactaccccgaacggggggcggtcaacccggaatgcggccagagcggcgttacggagtgagcgagaacggacgtatcgccgcaggtgggtcgacggcccggtggagcaccgggccgccgaggaggctcaggcccagtggagcgtggtctcgtggtccagccgcgggaggcggtcgcggtacgcgttctcggccgggtggccgaggttgacgacggccagcgaccggaagcggccgtccgggaagaactcggcgtcgacgccggccttgtcgaaaccggtcatcggaccggcgtggaggccgaccgcgcgggccgcgatgatgaagtatccggcctgcagcgcggcgctgaacgtgccgtccgcgatccgcttgtcgacgttgccctcgaaaaggttcttgagcccgggattgtgcgggaagacctgcggtacgtgctcgtggaactcggtgtccagggcaagcacggcgaccaccggcgcgctctgcgacttcgcccggttgccctcggcgaggtgcttgatcagcctttccctaccgtcggcggtacgcacgaacagcacccgcagcggctgcgtgttggcctgcgtcggcggccacttggccagctcccagatctcgcggagctcctcgtcggtgaccggcgtgggtgcgaagaaggaggcggtgcgcgcgtcggtgaacaggaggctgcggccctcgggggtcaggctcgaccgcgcttcagaaagagtatccacttctgaaaagctagctactaaagatcagaaagccatgaacgtacgccgtgagctacttcacccgggcagatgctgatcggcccaccgggcgatctgacccagcgccggcatcagcgcgcgactcgccgcggtcagcgaataggacaccgtgaccggcggcccggcctccacgtcacgcgcgatcagacccgccttggtcaggcaggacagccggttggagaggaccgagtcactgatcccgtcgatcgcgcgggacagctcgcggaagccggccggaccgccctccagcacgccgagcacctcggcgttccaccggcggccgaggaactcgaaggcgcgggccaaccccgccgccggggtctcctccaccgccgtcatgccggcaaagctacacgggccgggcaccgccggatgccggtgaccgcgccggtcggacctagtgctggctggcggtggcctgctcgggccagtgcacgctcatcttgcagtcgccgcaggtgagctgctcgccgcaggtggggcaccagtcgttggtgcgccgcagataccacccgagggcgaccccggagaagaggctcagcaggccgacgatggcggccacggtgacggcgccggtcatgccagcggccttcgccggaccaggcggagtccacggttgtcgagcatcgggtcatcgtcctcgcgggaggtcacgtagggagccgtgaaggtgtcgacgccggtgccgcgatgcgtgccggggtgatacgtcaccgtgaccgcgcgcggagaggcagcctcgatcacgccggcgcgccaaccgtcccgatagacccagaccgggtcagccgggcggtagctctcggccggcgccacatccgccggatcccgctggggcggggtgaccgtcggtgtggacgtcatccaactcgacatcacgatgcctccaaaagctatcgaggcggcgtcaggggcgctgcgaacggagcagactgagcgcaacggccgagcagccgagaattttcggcacgtcgccatcgcagccagtacgtgtgcgttagcagtcggtacgtgtctttccgctatcatgctcgtcatcaagtgcgtccgcaaggccgtctgcacgtgcatctgagcgcgcatcggctcgggccgactaggctggacaccgtttcgcggtagacgatctccgctttaggatgcatgcggctgcattccggcagtcacgacgcggcgacgaggagtcaggtgagcgaggccacgcaggaggatgcggcgggcggcggcccgaccgtgctgcgcattctgctcggctcccagctccgcaagctgcgggagtcgaaagggatcacccgcgacaaggcgggatatgagatccgtgcctccggttccaagatcagccgtatggagctcggccgggtcagcttcaaggaacgcgacgtcgccgacctcttgaccttgtacggggtggagagccccgccgagcgcgaaatgctgctcagcctggcccggcaggccaacagccccggctggtggcagcagctcaacgacgtcctgccgtcctggttccaggcgtatctcgggctggaggcggccgcctcgctcatccgcacctatgagatccagttcgtcccgggtctgctccagaccccggagtatgcgcgcgccgtgatcatgctcgggcacgccggcgcgtccgccgaggagatcgaccgccgggtcgaggtgcgccggcagcggcagcagattctcacccgtccgggtggcccgcagctgtgggcggtcatcgacgaggcggtgctgcggcggccgatcggcggggtcgcggtgatgcgcgcccagatcgaggcgctcatcgaggcgtccaagctgccgagcgtgcggctgcaggtcatcccgttcaccgcgggcgggcacgcggcggccggcggcccgttctcgatcctgcgcttccccgagccggagctgcccgacgtggtctacgtcgagcagctgaccagcgccatctacctggacaagcgcgaggatctggatcagtacgcgatggcgatggagcgggtctgcatcgacgccgatccgccgaacgacaccccggagatcctcggcaagctgctgcacgaggtgggacggccgctctgaggcgggggcggacgtgccctgtgcggggttggtgggcgggcttcggcccgccctgcgttttttaggtgctgggccgtgtgtgtggctttcagggcctttggcgcccgccttccgtgccgggccggctgcccaccggcgccggtggcgcgggatcggagcctcagcgcgtcggcatccggtgcgcaaggggtcaggcgcgttggcatccggtgcccagggcgcggtgcggcggcatctggtgcccagggcgcgggtgcggcggcatccggtgcggagggggcgggagcggcatccggtgcgcaggggcgggcacgtcggcatcccgtgcgctcggagggagcacggcggcgtccggtgcgcacggcgtgggcacgtcggcatcccgtgcgctcggagggagcacggcggcatccggtgcgcacggcgcaggcgcgtcggggccgcctgtttcgcccggcgacgcgcttcctgcttgtgccggccccgtgtgcgggcccggtggtacccgttgggtcagggcccggccggttcagtccggccggaccgctttctctgcacgcccggcgaccacggccggggcgcaccgtggccttcaggccaccaggttgtcgaagtccccgtcccggaccccgccgagaaacgcctcgatctcggcccgggtgtagatcagcgcggcaccctcggggtcgcgggagttgcgcacggcgacgtcgccgccgggcaggacggcgcactccacacagttgccactcgggttgctgcgacggctcttctgccaggtcacgccctgcagctgaccggcaggcatgccgttgaccacgtaggtcattccaagctccctcggttcgcccgggtcgccgatcgacccgggaggtgtgtccacatggctaattccggcgggaatgcaaatgcacgtgcatctggccttgcgtagtcacgggattctgagcatgataacgcacgtgagttcatccgcggagggttactcagagttaactccgagggtgacgggtcggtcgcggagcgacgtctgcggcaccggcgcaaaaggctccctggcgggggcgtccgagcgagaggtgacgagcgtgtcgattcccaacatcggcccggaacatcccgaaccgggtgaccccggcgcggccgacaatccgcgccggggcaacccgccgccggtccatcgcgacccggcgatcaccgatgacgtggtcgccgcgtcgtcgcgggccagcacggtgtcacagcggttcggcggtgggcgttacacactgagtcggcccggcggggtctccaccgccgagccgccggcagaggaggatgagtccgacgcgggtgagtgagctcgttcggtgtcacgggcatcgttccgtggcgcatccgcacgcccggtcgaggtggatggcctcggcgccgcgggtccgtgacgaccggctgcggccgagccggccacgctggccggtccacgagttcgccgaggccgactactgctacggcatcggtccgatccggttgcgcgtcgtgcgcgtcgaccggcaccggccgatcccgcacgagggcgaggtctggctcgcggtgcagggcatcgtggtcgacccggacggccgcgagggcgcggtgcgcgaggtgttgatccgggccgggtgcgtgccggtgccaccggtcggcaagcggacccggctgcgggtcctgcgggacacgccggtctgacggcggttcgcgacagaccaggtggcgacggggggtgtcgcgagatacgcccggcagaggtcgccggtgtacggctgaggctcgggtgtcgagggacgcccgtctgacgccgggtggttggcccggttccccgtgctgggccacccacccggtcctacccggtaacggttgtccgccgggggttcgtcagggtgtgggagtgagtggtggccggcgattcaaggggttgtgccgccggccgcgggatttcaccgagtgatgcggatcggccccgcccgggcagtgggcggggccgatccttgtgcgcctcaggcgatgtgcgtggaagagcctgatggcacgtcagggtttgcgggccaccccggcccagtagtaggccgcctgcggatcgtccgcctcgatgtccggccgccatgacgacaccggcaccagccccggctcgagcagctcccagtcgccgaagaggcgggcgaccgcgtcccgggtgcgggcgaccagcgtcatccccgcaccggtcgccgccgcgacggcccggccgacctcgtccgggttgaagtccgccgtcgggtgggtgatcgccaggcagctgccggacggcatcgcgtcccgcagcgccgcgaccttgccccacggatcgtcgtcgtcggcgagcagcatgaggatggcgatcagggtgagcccgaccggtttgctcaggtcgagggtgtcggtgagcaccttgtcgtcgaggatcgagcgggggtcgcggatgtcggcgctgatgtattcgctgcggccctcggggctgctcagcatcagcgcgcgggcgtggaccagcacgatcgggtcgttgtcgacgtagaccacccgggtctcgggggcgatcttctgcgcgatctcgtgcaggttgggccgggtgggtatgccggtgccgacgtcgaggaactgccggatgccctccttggcgaccaggtcgcgggcggcgcggtggacgaacttccggttttccccggccatgtagcgcatgccggggatggcctggatcatcgcttcaccgacggcgcggtcgacggcgaagttgtccttgccgccgagccagtagtcgtagatgcgggcggagtgcggcacgttgatgttcacgccgggtggcgcgacctcgtggggtgcggagttgtcaccgtcctgcacgaccgcctccttgcgccggaccgtcgatcttcgacagtccgtccagcctagccccgacgcttgatcgttaggcggccgagaagtggtcgacgcagcccaggaggccggcgccggagaccacccgatcacgtccgccccgcttggcagcgtacagacgaccgtccgcaatggacagaaggggtgcctgaccgggtgtggccggctcgccgacaccggcgatgccgatactcaccgtgaccggcaggtggctggtgatcggtgcccagtgctggccgcggacggcccggcggatggcgtcgagcacggtcgccgcccggcgtaccggagtgtcggggaggacgaccaggaattcctcgccacccatccgggccacgaaaccgtccgggcaggcggccgcgacctcaccggccagcacctgggcgacctggacgagcacccggtcgccgacgtcgtgcgagagcaggtcattgatctgcttgaagtggtcgaggtcgaccagggccaccgccagcgaccggtcggtctcgatgagcccgggcaaccgctcgtcgacgtaccgccggttgtgcagtccggtcagcggatcgcgccgggcctgctcccggaagcgttccgcttcctgccgggcctcggtcgtctcgaacatcgcctgccgggtccgggcgcgggcctccttctgcagcgactgctgctggtggtgcatctcgaagaagtttttgtgcgcgtggaacgcggccgcgaagtcaccggccgcggcgaacagctcggcctgctcctggagcacccggaccaggctctcgcccaggtcacgttcgatgcagagccggcgtgcctcgtcgaggctggcctgggccggcgccagctcctcgaggccgcgctgagcctgggccagggtgaccaggtattgcgccatgtcgttggcgtcgtcccatttgccctcggcgtgccgggcgatgcagatccgcatcgtctcggcggcggccgcgtagtttccgttgctgacctggatcgagccgatcgtgtcgaggaacgcgggctcgagcgggatgcccgattcggcggacagctgttgcagccggtcggccagcgcctcggcacgttcgcggttgccggtgctggcctcgacgtaggcgaagttgttcagcacgctggtcagcgcgggtgactggaggtgctgcgccatctgctcggcctgcgtgtaccgttcgcgggcggcgtccagatcaccggcgaagtagagtgcgtcggccagcttggtccggtgccagacctgcatgtgttcggtggcgctgtcgtcgagcagttcgacggcgagcaccgcgtgttccagcccctgctcggcatcgcccaggtgcaggtggatggtgacccagaccaggtgggtgcgagccagcagccggcgggcgtcgtggtcgaccgcccactggtgcacgtgccagatctcctcggcggcccgggccacgtcgccgcagcgcatccgcatgttgatctggcagagccgggcgcgggcggcgagcaactcgtcgcccaggccgacggcgatccgctccaggtcgatggtgcgggccagctcggccgtggcatcccaggatcgacggtcctcgatggtgaggaggactgctgacagggtctcggcgtccatctcgtgcggttctcctctcccaggtcgctggactgatcgaccgtgccgctccggggctgaggaaaacgtggatgatcagcactccgttatccgaggttagctctccgtcaacggagagtttccggttccgtgccgtgatctgaatcgcggaaagggcgcccggagatcccggacgcccgcataacagttgatatgtctatttcgcgccgagggccgccggctccggcgtcgcggccggagcggcaagatccacagtgctccgcagcttggtgggtttcatcgccaccgccgcgatcaccccgaccaccgcgatcgccatcgagatcaggaagatgtgcccggtcgcgtcgccgtacgacacccgcacgatgtgctggatcgccggcggcaggctgcccaggttcagcgcgctcaccccggagctcgactgcccggccggcaccccgagggcgctgagctggtcggtcatcgagtcggccacccgacgggcgagcaccgcaccgagcaccgacaccccgatggtgccgccgagcgagcggaagaacgccacggtcgacgaggccgctccgatgtcccggagcgccaccgtgttctgcacggcgagcaccaggttctgcatcgacatgccgacgcccgcgccgaccaggaacatcgcgatcccgacgtaccagagcggggtgtcgtggtcgaggacggagagcccgccgaagccggcgaccaggaccagcgtgccggtcaccacgtacggcttgatgttgccgctgcgggtgatcagccggccggcgatcgtcgaggcgagcgccaggccgaacatcatcggaatggtgagcaggccggccttggtggggctgtagccccggccgatctggaagtactggcccaggaagaccgcgccgccgaacatcgccatgccgaccgcgaggctgcccaggatggccagggcggtggtgcgctgccggacgatcggcagcggaacgaccggctcggcggcccgggactcgacgagggtggccagtgcgagcagcaccagaccggcgccgaccatggcgaaggtctgccaggagagccagccgaacgagttgtccacgaacgacacccagaccaggatgacgctgacgccggccgcgatcagggtggcgcccaggtagtcgatcttcacgtcggcccggcggacgaccggcaggtgcagagtccgctgcagcacgatgagcgcgacgatggcgatcgggatgccgatgaagaagcaccagcgccagccgagccagtcggtgtcgacgatgatgccgccgagcagcgggccggcgaccgtggccaggcctatcacgccgccgaggtaaccgttgtaccggccgcgctcgcggggcgggatcatcgcggcgatggcgacctggacgagcgcctgcacgccgcccatgccgaggccctggaacgcgcgggcggcgatcagctgctcggtgttctgcgtcaggccggccacgatcgaacccagcacgtagaccacgatcgagatctggaccagcagtttcttgctgtacaggtcggcgagtttgccccagatcggggtggacgcggtggcggtcagcagggtggcggtgaccacccacgtgtactgcgtctgggtgccgttgagcttgccgatgatggtcggcagtgcggtggagacgatggtggagctggacatcgcgacgaagagcacgagaagcaggccggagagggcctccaggatctcgcggtgggtcatcgctcccggctctgagcgcgacgcggacatggcggctcctcgggtagtgggttgcacttcccactatcggccagtgttgcgcactgggcaaactttctcactgggaagtgatgcaggtcgccggtaggctgccacgcatgagcgacgacggtggcctgcgggagcggaagaaggcggccacccgccaggccctgcacgaggcgtcgctgcgcctggcgttcgaacacggcccggaccggatcaccgtcgaggcgatcgccgacgaggccggggtctcccggcgtaccttctccaactacttcgccaacaaggaggaggcgctgttctacggtgacctgcagcggatgcgcctgctcgccggcaaggtccgcgagcagcccgccgggacatccccgtgggaggcgctgagcagcgcggccgaggccttctacggtgagctcggcgatctggacccggagtggatcgcgcgcagccggctggtccgccggcatccctcgctggccgccacccaggtgcagacgttcgccgcgctggagcagggcctggccgacgagctggcggcccgactcggtgccgccgacccgatcggcatgcggtcccggctgatcgccgccaccttcctcaccgtgctccgcgtatcgctcaacgtctggctggagcgccgccccgacctcacgttctgggacctcgcccgggacgcgatcgccgacgccggccgcggcttcgcctaggaccagggtcaccacccgatgacggtggtacgacgtgagcgccgcaccccccgatgccctccagggtgcggcgctcacgtcgtacgaaatcggtcagcccttgaatcctgcgaagatcttcgagaactcgaacgccgtctggctgatgttggtgcactggaacagtgcgccctggcaggcgttcttgtcgcgctgcatctcccagaaggagacgaagccgacgtggttggcgttggcgaaggcgaccaggtccctggcgtcgctctgggagaacgtgccgctgtcgtcgttcttgccgatcatcggggtgacgccgaccatcttgaaggccgccgcgtcgctgttgccgtagatcgacctgatctggtccttggtcgatttcacggcctggatcgccaggtcaccgtagtcctggccggaccggccgtagtccatcgccatgatgttgaccaggtcgaggtcgacgccggcgttcttggccgacttgaccacgttgagaccgtccgcggtcaggccctccggcagcaccggcagggtcagcgagatcttcaggcccgggttggccttctgcagaccggccagcgcggtcgagcggcggttgatcgaggcggtgtcggccgaggccgcaccctcgatgtccaggtcgatgtacttcaggtcgtacgcgtcgacgaccgcctggtactcggcctgcagcgcgctggtcgaggtgcaggcctgggccagctcgacgccggtggcgccgccgaaggagaccttgacgtcgccgccggccgagcggatcgcaccgatctggtcggcgaactgcctggcccgcgggtcgaaggcgccgaaccagctcgccttgcagccggaggcggtgacgaaggccaggctgaacgacttcacattgccgccgccggccagcgcggacagggtgccgccgttggacagcacacccatgtcgacgtacggcgcgaccagcaccccgctcgccgagccggtgccgccggtggcggtcggcgtcgcggtcgcggtcctggtcggggccgggctggtggcggtccgggtgggcgtcgcggtgggcttggcggtggccgtcgcggtggcggtcgcggtcaccgtgggggccgcggtcgcgccgccggcggtgcaggacgcgccgttgatcgtgcagctggccgggtcacccttgccggccacgacgaagccgaatgagatctcgccgccggccgggatcgtcgggttccacgccgcgttcgtcacggtctcgacgttgccgctggtggtcaccgcggcgtcccagacactgccgagcttcgcggtcgacggcaggccgaagaccagctgccagccgttgaccggcgcgtcggtgccgttcttgatcgtgtagtgcgcctggtagccggtgccccagtcgctgtccttggcgaacgacgcggtgaggctgcccgtgccgccgtcggtggcggcgaacgccgcgccgataccgccaccgaccgcgagcagcgcggccgaggagtagatggcgagccgcatacggctgcgttgcatggggacgctccgatcaggggggacgctgacggaggcaattctcgagcgaacccgtcttaaaggtctcgggtcacagccttaaagatccttaaatgctcatcgggtggccagcccgccgatcagcagcgccagctggcggcgccaggcgtggggttcggtcgcgtgccggttcaccccggcgttggccatcatcaccagccacaggtcgtgccgggtgaagtcggcgcgcagccggccggcccgctgcgcccgggtgagcacgtcgaccgcccgctgctgggccgcggcgcgcagcgcggacagccgctcgtcgtcgtcgaacgcgtcggtcaccagcaactcggccagcccccggtcggtggcctgcagctcgcagacccggctcaggtagccgatgaacgcggcccacgggtcggggtgctccagcgcctggtcggcgagccggaccgcggccgtcatgtggccggcgaagacctcggcgatcaggtgccggcggctcgggaaccggcggtagagggtggcgttgcccaccccggcgcgacgggcgatctcgtccagcgaagcgtccaggccctgctccgcgaagacctcgcgggcagcggtgagcagggccgctcggttgcggcgcgcatccgcacggagccgggtggccatgcgcagaagaatacgacgttcgggaaggaatcccaccagtcggtgttaccgtcgcctcgatcaagctcagcggcggaagaggacgcggcaatgcagcagacttcgatcgacatcccagctgccgacggcccggccgacggttacttcgtcaagccggacggccccgggccgtacccgggaattctgatcttcatggacggcttcggggtgcgcccgcgactgcgggagatggccgaccggatcgccgagcgcggctatgcggtgctgctccccaacctgctgtaccgcgaccagcggagcccgctggtcgacccggctgaactggccgacccggagaagcgcggcgccgccttcggccggctgatgccgatgatgcagaacctcacggcgccgcggctggtcgccgacgtcaccgcgtatctcgacttcttggccgcgcaggagggcgtcgcgcccggcccggtcggcgcggtcggctactgcatgggcggccggaacgggctgatcgcgatgtccgcgttgcccgaccggatcaaggtgctgggcagcttccacgccggccgggtggtgaccggggacgagcacagcccgcacctgggggtgggcgcgatcaccggggaggtctacttcgggcacgccgacaacgacgcctcgatgaccccggaccagatcaagacgctcgaggcggcgctggacgaggccggggtgacctacacgtccgagctgtacgagggtgcgccgcacggttacaccatgtcggacacggcgatgcaccacccggccggcgagcagcgccactgggcggccctgttcgacctgctggaccgcaacttctagttggcgtacaggccggggaagtatcgatcgatcgcggtcacgtcgtacacgtgccggatctcgacgatcttctcgtcctcgaccgcgaggaactcggccagccgggcactgccgaacggcgccgtgagatcgtagatcagcgcggcgccgtccagcgcgtccgtccgggcggtcagcgcgacatggtcggcgaagaccgctatccggtgcaggacctgcagcaactcctcgtcgtcgaccggggcgtccaggttccactccacctcgacgtgcgggctgagcacccggcgggcggcggccaggtcgtccgaggtccaggaccggacccagaagtcgacgacatccataaaggcactttaggcggaaagcgtcgactcggcgctcacgaacgtgtagccggccgccttgatccccccgatcaggtccttgagatggtcggtgcccaggtaggcatggtagaagcagctggccacgccgtcgcggaccaccaggttgcgctgcgccgaggcgacgatgtcggccggcagccggaccgggtggttgttgaacgcctcggtctccacgttgccgatgttctccggcaccaccagcgagccgtagacgtcccgcaccgggtacgggaagaactggccgaactgccgggagtagtcgaacctggcgccggtcagcacgcccgggaagtacagcccccggtcgtaccgcttgccgaacagggcgttgaccacctcgtagtccggcgcgctcgccgcgtagtgcgggaactcgaacagcctcggcgagcccagcccggcggccaggaacaccgcacccgacgacatcatccggccggtcgcccaggccgccgagtcctcggccaccggaccgtcgtagaccacgttgtcgcccgcgtcgacgtgtgccttgtagaactcgaagtcgttcgcgctcaccccgtcgtacgggttggccaccgaaccgtactggtgggtgtagccgtgcatgaccagcgtgccgcccctggcctgcatgtacttgagcgcggccaccaccttgggcttgttgagcagggtgtagtcctgggccttgccggtgccgacccccttcgggtcccggaaccgggggtagaccgcgacgctgaacggcaccttctccgcgaacaggaagtcggccaccgcggtgagctgctccgggtcggcgtccggcccgacgtcctcgatccggatcagcgcccggtgccgctcggtggtcccgccgccgagcgtgtcgaaaagcaggtcggcgaaggccaggtagcggtcgtcatgggtgacgtaggcgaacgggatctccccgacgtaggtcaggttgcccgaccgaaccgcccacgggaagccggtgccgtccgcccgcaccgcggtggccagcgtggtcaccttggcgctgtcgccgatcgacaggttcatgatcccggacttgttctcggtgccccgggtgagcttgcggcccttgtaatccacctcggtcacgtcggcgaagtcgaacgtgccgctggcgaagccgtacttggcggcgaagccgtccttcgccgccagctgccagatgttgtcgtagacccagaggacctgcttggtggtggccatcacgtcggtgaggaaggcggccggcagcggctcgtcgtacgtcgagcccaggtagatcaccgcggtgtaggcgctcaggtcgccggccttgtaccgggccaccggcgccgccgtccacgagccgaaccgcgagctcaggttcgccgtctgggtggcgtagacctcgcccagccagccgtagtcgccggtggtgtcgtacaggaccagcgtcttggcggcgccggcgcccgggccgcccctccccgacttggtgatcaccgaaccggtggccggcgcggtgctggcggcgtccgcctggaccgcgttgatcccgaccccggtggccacggccacggcggcggcgccgccaccggcgatcagggtgcgacgggtgaccttcttggcgcgcatcaggcggtggctccgatctcggtggcggacggccggaccggcatggcgtccggggcggtggcgaggccgagcagggcggcggtcgcctgggcggtgcgccgggcggcgagaccgtcgccgtacgggttgccgccggcggtcatcgcgtcccggcggtcccggctgtccagcagcgcggacgcctcggcgacgatcaccgccgggtcggagccgaccagcttggcgcagcccgcgtgcagcgactcgacgcgctcggtgacgtcgcgcagcaccagggcgggcaccccgaacgacggggcctcctcctggatcccgcccgagtcggtgagcaccaggtacgcctcggacagcagccgggccaggtccgggtagggcagcgggtcggtgacggtgacccgctcggcgccggccagcgcggcgtccacctgggcgcggaccgccgggttcgggtggctgggcagcaccacctcgatgtccgggtacttcgccagcagctcgttgaccgcgccgaggatccggtccagcggctcgccccacgactcgcggcggtgcgcggtgaccaggaccaggcgcttggtgctctcggcgcgggccgcggccaccgccgggttctcgtagggcagccggcgggcggccaccgccagcgtcgcgtcgaccacggtgttgccggtgatcagcacgtcgctcgcggcgatcttctcgtccagcaggttcatcgcggccagcggcgtcggtgccaggtgcagcgcggcgacctgggcgaccagccggcggttgccctcctcggggaacggtgactccaggtcaccggagcgcagaccggcctccaggtgcacgaccgggatccggcgccagaacgcggccagcgcgccggccaggctggtggtggtgtcaccctgcacgatcaccgcggccggggtgcgtaccgaccacagctcgtcgagctgctggatcatcgcggtgagcagttcggcctgggtgccggtggagcgctcgacggtgagcgtgatgtcgggttccaggtcgaaggcggccagcgcctgggtgaccatggtggggtgctgaccgctggccagcaggatcggcttgagcaggccggcctcgcggaacgcgagcgcgaccggggccagtttgaccgcctccggccgggtgccgccgatcagatggacttcgcgaagggacattcggggggagccttccttcacttgctggcgatgggggatggtggggcgcctgcgggaaatcaggcggtcttcagggcgagcggctcctcgacgagccgctcggtcttggcccaggcctgcttgccggtcagctggcggcccagcgcgcgataggtcgcggtcaggccgagcagcaggaacgccgggtaggccagggcggcgagcagcatccgggggagttcctcgtcgccgcgcttgacccggtgcaccagcacccagaccaggccggggaacgtggtgaccaccgcccagatgccgaggctctcgcccagggcgaaccagctgggcaggatcggcaccgggtgcccgatcagcaggcccagcgcgccggccgtgccggtcagcgtgagcagcatcgcgaccaccgcgttcgcccacggcgagaccaggtagtgcaggatctcgaccagcgcggtccgggcgatgttgccggaggcgaacagcgagcccaggtagcgggcgcactggatgttgccctgcgcccagcgggtccgctgccgggtgagtcgcttgatgtcgaccaccgcctgctgggtgaccgaggcccgcgaggtgtagcggatcgacacccccttgaggtgcatccgcaggcccagttccatgtcctcgaccaggcagctcgaccagggcgtgtcacccagcgagagcagcgtggagaggcgactgaactggccgttgccgcccaggcccacggtgtccagcgagttgcgcaggttctggcaggcgtccacgatggcgccgaactccaggtcctgcaccgcgcccaggagcttgttgcggttgcggatccggacctggacctgcaccgcgccgaccctggtgtttcccatcagtcggccgacctcgaccaggatgttgtcgctgccctggccgtcgccgtcgatgatgccgagcaccacccgctcggccgggacaccctcctgctcggcgatccgggcgatgaaccggtaggccgcgttcagcgcctcgcccttgccctgccgggcctcgggcagctcgcggcgcatcacgtgcaggcgcgggtggtcgatcgcggccagcacctcgggcgtgcggtcgtccgatccgtcatcgacgaccaggaccctggccaaggtgcgagccgggccgcgcagtccgagcgcagccgtgaccgtgttggcgaccaccgcctcctcgttgagcgccggcacgatgatccagaagtgctcaggcctgccgtcaccgctggccagcgcctgattgaccacccgggcgcggtgcgtgccgacgtagcggaccgcgaaccagaccaggatgacggtggagagcggccaggccagcaggatcgcataacccgcgaccgcgatgagccagccgtccgaagccgacatctttacccccgttcctgccacgagtcgtgacatttcaggggcaattacggcggggggaggcgggacctaagggtcatgcgccggacgattccgggatgcggccgaaaggttgaggtcgcggtgacccacggtgcttttccggctacggagaaggcggccaccgtccggtgaccgccttcgaggtcctgctcagtcgtccagcaggctgggattgtcgcggagcagcgcggccagccggcgggcggcctgctcggtctcctccgcggcgcgctccgcgtggaacggcttcggctgcggggccggttcgaccggcggcgcataggcggccggcggcggcggataggcgggcgccgggggggtcacgaacgggcgctccgcggtcggcggctcgtcataggtgggcccgaaccggtcctggtcgtcgtggctgccgcggggcggcggctccggatcgtccaggtcgatctcgatgtcggcgtgcgcccgggccggctcggcggcggtccgctcgaccacggtgcggtccgcggtgacctgcacggtgccgtcggcgaatccgaagtgcagcagcaccggatcgccggcaccctcgacaccgacggtgacgcccaggtgcgggaaccgggcgatcaccccggcgatggcctcgaccagctcggtcaccgcgggcggagtgcccggagcctcgccggccgcggcacgccgccggagctcgtcgcggcgggcaagcttgtcgagcgcgtcgtccagtccgcctcgcacgtcaccgtcctcttcctcgcacggtcgcccggtacctcaccatcctgtgcctccgggcgacccgcgcacaccctacgacttcatctttatcgccttgtcgagagcctggtccagaacgacgaggagagcgtcgcgcaccgaggcgcggaaccgggcgtcgtaggagatcaccgggacgtcctcgcggaccgcgagcgcccagcgcacctcgtcgaggctgtacgccatgttgccgttgaacgtgttgacaccgaccacgaacgggagcccggcccgctcgaagtagtcgaccgccgggtagcagtcgtcgatccggttggtgtcgaccacgaccagcgcgcccagggcacccttgaccaggtcgtcccacatgaaggcgaaccgggtctggccgggcgtgccgaagatgtagagcttcagcgtctggtcgatggtcagcacgccgaagtccatcgcgatggtggtggtggtcttcgtggtggcctggccgacgttgtcgataccgatcgactccgaggtcatctcggcctcggtggtcagcggcgcgatctccgagatcgcgccgacggtcgtcgtcttgcccaccccgaagccgccggccacgatgatcttgaccggaaccggcgccttcttggccggcgcggctccgcccgggatgcgcgcggtggcgacgacgcggttagctgatggatcgaagtccacggatcactcgcatgatggtctcggggtcaggggtgtcggtgtcccgtccctgcacgtccacctgaccggcggcgcgcaggtcgccgacgaggatctggcagacgcccaggtgcaggcgcaggcgtgcggagatctcggctaccgaaatcgggctctcctccaggagagacacgatcgccctggtttccggtgaaagccgggacgggggtgcgccgtgcaccaccgccacctgagtctccataccgatgtcgggatcgcctccatcggtccgcccggccgtgatgacgaacgggcgcagagtgttggtctgtgctggctcgaccggcggctgttccccggtgggggtgtagccgccggccgaatgcttcggaccggattgcaggaagggccggactccggagcgcgccggaggaaccggttcgtcggcggggtccgggtacgtcattgctggacggcgttcttcagctcggcgatcagacgcgggctcagggcgccgccggcccgggtggcgaagagggtcatctcgtacgccagagtgcccaggttcgccgaccggtcggcgatgacgccgagcaccgagccggcgctgatcgcggtgaccagcaggtagccgtcggccatgtcgatgatgacccggttcagggcgcccagccggtaccagctggcagcgccaccggccaggctggtcagaccggagaccacggcggccagccgctcggcgttgggccggtccttgatcgcggacatggccatcagcagaccgtccgaggagacggcgatggcttcgatcacgcccgcggttccggacgtgaaggagtccagcagccagttgaaggttttggcttcggcgctgagctgactttgcgcggtggggtatggggaagtcatcgcggttgtccctcgggttgtggctgagtttcattcagggcgagtgcgacgccgtactcgaactgatccatcagtgcgcgtgcctgctccgggtccatcagggtcggggccggcgggagaatcggttggtgcggctcgtcccgtggcagggtcgctcccggcacgcggcgagtcaaccctccgccaccgagcggcggcgcgggcgcggccggggccggtggcgcggccggagcgggggcgttccactgctgggccggctccggggtgttccactgcggcgcggcctcctgtacgggggccggagtgctccactgcggcgcggcctccggggcgggggccggagtgctccactgcggcgcggcctccggggcgggggccggcacgttccactgcggcgcgggcatttccggcagcgaggccggcatggcccactgaccgccggcgaactccggcgccggcagcgaggtgctggtctcgtgcgcccggctgacaccctgctcgaaggcgtcgaaggcggcccgcgcggccagggcgtcgtcctgcgacggcgccgcggcgtgctgcttgggaccggagtccatcgggagctggctgcccggcacccggcgacgcagcggcttgaggccgccggccggtgagctgaccacgggttccggagcggtcggctccggagccggggccgggtggcccgagttgctggccggagccatcggcgcctccacggccggagccggggtgttccaggccggctccgccggctgttgcgggctgttccagtgggtctcggccggagccggggtgttccaggccggctccgccgaggcggcggccggggtgttccaggccggtgccggggaggccggggccggggtgttccaggccggcgacggcgaggccggggccggggtgttccacccggacgccggggactccgggacgctccacgaggtctccgacggggccggggtgccgctccaggacgggccggccggcagcgccggatcggagccccaggccggctgcccggcggcgggcagttcgggcagcgcggccgggttgcgcccggccaccgggatgccgctgttgtaaccctgcgacgcctccacctgccggtacggagcgctcggctcctggtaggcgacgcccggcgagtacaccggctcggcatcgtagaccggctgaccggcgtacgggtcctcgacggccggctgcgcggggaccgacccgccgaacgcgttccaggacgggaccgactccagcgtctgggtggcccggctcagcttgttcgggtcgaacggctgctggctgcccgggacggtgcggatcgcggtgctggcgatcgccacctcggcggtgttgccgcgcagcgccccgctgaccggcacggcgtactccggctgcccgtactgctgctcgaacggctgctgcgggtagctctgctgagcgaccggctcgcgctgcatcgggatctgcggcaccgcggccggggccgggataccgggggcggccagattctccaccctggcgatcaggtgctgcgggctcaggtcgatccaggccgtgacaccgccgtccggggtgtcggtgagggtgacctcgatgccgtgccggcgggcgagccggccgaccacgaacaggccgagcacctcggtgggggccaggtcgaggcgctcacgacgggtcagccgggcgttctcctcggccagacgctcgggctgcaggcccaggccgtggtcgatgatcgccaggcgggcgccaccgcgcagctcgtccgcggagaccgtgacgctggtgtgcggcggggagaacgtggtggcgttctccagcagctcggccagcagcagcgtgaggtcggccaggatggccggcaccacgacgatctcctcggggacgtccacctcgacacgggtgtagtcctcgatctcaccgagggcgagacggacgacgtcggacagcggcagcggcgccatgtgctcgttcgcacccgcgccaccggagagcacgaccagcgcggacgcgttccgccgcagacggctggacatgtggtccagtcggtacagctcgcggaggcggtcgctgtcggtctcccggcgctccaggccgtcgatcagggacagctgacggccgaccaggttctgcgtacgacgaccgacgtggccgaacatctgggcgacgttacggcggccgagcacctggcgttccaccagccgggcggcggtggtctgcacccggtcgaacgcccgggccaggtcaccgatctcgtcctgggcctcgacgtcgaccggatccagtcggatcggccgcacctgggcctcggactcgtcgtcggccacccgctccagctcggcctcggcggcgcgggcgatgcggtcggcggaggcggtcaggcggcgcagcggccgggcgaccgcgcgggccatgaagatcgagagcgtgaccacgaggatcagcaggacgaacgcgccaccaccgacgtacagcgcctgctggatggcgctgttacggctggcggtgaccgccacgtccacgtccttggccacgcgcttctcgacgaaaccaccgaggaccatgacggactgcagtgaggggaacagcgaggtgatcgagggcagcttgttcagcgcctgggccgggttggtggccagaccgtcgacgaagccggagcccacccgggactggaacgcgtcctgggtgttcaggtagagcttgtactgcgcgtcggtgaagtagcccttggactgggtgatcaccgactggatctgtgcgaacgagttgttgaacagcgtcagcacctgcggcgcgaaggaccgcagtttgcggttgggcgcctggttcagcaccgccgcgtacgccagatagcaggaggcctggctgatcaggtcgtcggagcgcatcgagcgctccagcgcgaagacctgctggccggtcttggtggtgaggtccgagtggttgctcagcccgaggccgtcgatcatcggcgtgatgacgctggtgaagtcggtgacgatcgaggtggcgttggtctggccgttcaggacgttctgccgggtgctgttcagcttggtggccagcagcaccgcgcggcgcagatcggccggcagcacccggtccttggagtcgagcagctcggcgaccttctcgccggcctcggcgctctgcaccaccagggtgggctcgtcgaccaggtgcagggtgtagccgaccgacagcaggcgctcctcctggagctccaggaccgccgaactcaccgcggtggccagctgcacgctgtccgaggtgtcctgcgcctcgttcgcggcctggacacggttgtagatgatcggcacggtcagggcgagaacacccagcagcggcacgagcaccagcagggcgagcttgcccaggatgcggaacttaccgaagagcaccggaacgctcccgcccgccgccgtagttcggagtgtcgccgtagttcgggatcgagtcgtacgggctgcccgtcgggttgccggccggcaccgaggtacccgcccggaccgacacgtcacggctgccctggccgggctcgaccagcgtggcctggacctggcgggcgcggccgcgggtccacagggtggccaccacgatcagcacgatcgcgatgccgagcaggccgaaggcctcgatgcgcttgtaggtcagcgagctggaccggtcgtcgagccggccggacatctccttgaggacgacgccgctcagcgcgctcagcgcggtctgcagggtcgactgcgcggtcaccagcgtggacacgttcggcgcgccaccgatgttggcgccacggttggcggcctcgatcccgcgccggaacgagtccaggttgctcaccaggttgccgctcagggtggtgctcttggtgctctcgaccgcctcctggaggctgtcggtcagcttggcgaccgtctcctggaccttcagggcctggtagccgaactgcacggtgagcttcgccttgtccgccttggtgcgggccgcggggaccatgttcgcgtagtcgctcatccggctgacgaaggtgaccgcctcgggcatcagctggccgacgacctcctggaggaacgagacgtcggcctccgggtcgcggttgagcctggagttctcccggaccacgtcgaacagctcgacggccaggtcggcggcctcgacgtgggccgtgaagatctgctccgaggtgccggtcaccttcggcagcttggcgatcttgtccttcaggtcgctccaccggctgtgcgtctcgagcgcgtcaccgagccgcccgtcgacaccctgcacgcgggccacggccgcggtcaccgaggccggctccgcggcgacgccctgcagcgccgacgcctgcgactcggccagcgccgagaccagcgggcccagcacggtcaggtactcgacgccgtcctgttcgagctggacggtgtcgcgctgctgggagttctcttgcaggacccgcaggaacaggcccgcggccggcagcaggacaagagccgtcagcagcaccgcgagagcggagcgtaaacgggttcgccggctgttcaccgagactgacattgctttcgtcctccgccatgcacacacgcgatgggccattggggggctaccgaacgtagccgagcgggcgcaccgatctgggtcaatctatccgagaaatcctcaagaaacccctttccaagggtcagagttcgctcggctgatcgggggatacgcagcaccgtcgcccgcgctctacgcaagcttttgtcggcagggtgacaggtgccgggcagatggtatccggcctgcggctcgaacgtgaatatgagttctacttcggattcgttacgtcttgggtgcgatgctctccacggaaagtgccaaggcaattacggaaaggcaaaaaagcacgcactgtagccgttccggcacacgaaaaagggcccctccgtcccgctttcggtacggagaggcccgattgacttaaatcctgcccagtgccctgcgaagcgggtcgagaccgagaggtccgaggtccagagcgtcccgatggaacgccttgaggtcgaaatcggcgcccttgcgctgtttcgcctcggcccgggcctgcagccagatccgttcgccgatcttgtacgacggtgcctgccccggccagcccagataccgcttccactcgaagcgcagcacgtcctcctgcatccgggagtgcgcccgcaggaactcccagcccaactccggtgtccatcgggaccccgggtggaagccgaacgggttgtcccgcgggatctccagttcgagatgcatgccgatgtcgatgatcacccgggtcgcccggagcgcctggctgtccagcatgccgagccggtcgcccggatcggtcagatatcccagctcgtccatcagtcgctcggcgtacagcgcccagccctcgccgtgcccggagcaccaggccagcagccgccgccagcggttcagctggtcggcccgcagcagggtctggctgacctgcaggtgatggccgggcaccccctcgtggtagacggtggtcacctcctgccaggtggagaagacctgctggccggcgggcaccgcccaccacatccggccggggcgggcgaagtcctcgctcggcccggtgtagtagatgccgccgtcgctggtcggggtgaggcagcactcgagcttctgggccggcggctcgatgtcgaagtgggtgccgttgagctcgctgaccgcccggtcggagagcgcctgcatccagtcccggaaccgctccttgtccgggatgatccgcgccgggtcggcgttcagcgcggcgaccgcctcgtccaccgacgcgcccggaccggcgatgacggccgcgacggcctgcatctcgcgggtcaggcggtgcagctcctcgaagccccagtggtacgtctccagcaggtcgaccttcgcgccgaggaagtactgcgaggccagcgtgtaccgctccagcccggcggcctccttcgcgcggccccggggcgccaactcctcgcgcaggaaccggccgaagtccgcggtggcggcggtcgcggcggcggcgccccggcgcaggtcctcggcgagcccgccggacgcctgcaaccggccggccagtccgtggaagaagccgtcccggtccgggtcggcccacgcggcacactggtcggcgaccgcggccagctgcaccgacgggctgaccacgccccggtcggcgccctccagcagggtccgccggtactgccgcagcgcctgcgggaaggcggccagccgggtgacgatgttcgccaccgcctgctcgccctcggccggcatcaggtcgagcaccatccgcagctcgtgcagggcgctggtgatcacgttgacctcggtggccgcgatgccgctgtccagccgggccagttccaggcccagccgttcctgcatggcctccttggcgacctgctcggtctcgtgttccggctcgttcacgtcgaggtcgttgagcgtgcgacggaccagttcggcccgggccgcgaacccctcgggggagaggtcgtcggtctggtcgtcgtggccggtgatgccggcggcggtggctccggtcggattcagcgcagcccactcatcgacgtatcggttggcgagttcgtcaattcttcccacgggccgactttatgggatgccgcgggaactcagcgctcccctttcacccgtgggcggcggcccaggccagcagccgctcggccggccaggtgttgaccacccgatcggcgggcactccgcacagcgccgcccgctcgcagccgttgccgagccagtccagctggcccggggcgtgcgcgtcggtgtcgatgctgaaccggcagccggcctcgaccgccacggtgagcatccgtttcggcggatccagccggtccggccgggagttgatctccacagccttgtcgtgctcgacgcacgcggccaacaccttctccaggtcgaaggtgctcggtgggcgggtccgggcggtccggtgggcggcgtccccggccccggcggcggccaccttgcgaccggtcatgtgcccgagcacgtccaggtgcgggttggcgatcgcggtcagcatccgccgggtcatccgggccgtgtcgtcgcgcagtctgctgtgcaccgaggcgaccaccacgtcgagccgggccagcagctcgtcctcctggtccagggaaccgtcctcgaggatgtccacctcgatcccggtcaggatccggaagccgtccggcagctgggcgttcagcgccgccacgtggtcgagctgacggcggagccgctcggccgtcagcccgtgcgccacggtcagccgcggtgagtggtcggtgagcacgaagtactcgtgccccaggtcggccgcggccagcgccatctcctcgatcggcgacccgccgtccgaccagtccgagtgcacgtgcaggtcaccccggagcgcctcgcgcagcgcggccgccgcggccggcaggtcggccccctcgatgctgagcagccggcgcagatagaccggctcctcgccggccagcgactcggtgacgcaccgggcggtcacctcaccgaccccggccagcttggcgagcgtcccggccgcggcgcgctcggtcagctcgtcgccgggggtgcgggccacggcggcggccgccgaccggaacgccttgacccggtaggtcgcctcgttcgcccgctccagcaggaacgcgatgcgccgcaggtcggtgaccgggtcacgggatgccataccgcccagactaagtggaacggtaaggggcttgcccgtaaagattcacatcggtaaggtccgtgcgctgttcagggtgtcttcagggggaaagtatgcccaccgcgcttcgcgccgccgtatcggtcgtcatgctggccggtttctatctgctcggcctcgcccagctggtcctggtcggctggctgatcttcgagatctggcagcacctgcacggggcgggcgcggtcaagctcagctacctgctgctcgccgcggtcggcgcggtgctcgccgggctgtggcgggcgatccgggcgaagcccggccacccgcacggcctgatcgtcacccccgaccagacccccgagctgtggcaccaggtgcgccagctggccgccgaggccggcacccgggcgccggacgagatccggctggtgcccgaggtcaacgcggcggtcgacgaggagaccaggctgctcgggctgatcggcggcacccgccggctgtacatcggcatgccgctggtgcagaccttcaccgtcgatcagctccgctcggtgctcgcgcatgagctgggccactactccggctcgcacacccggctgtcggcggtcacctaccgcggtcggctcgccatgcacgagacgctgtccaacgtcggctcgttcaacgtgttcggctgggtgttcaaggcgtacgcctggctgtaccagctggtcagcagcgccgtcgcgcgccggcaggagctggaggccgacctcgcctcggtccgggtggccggcgtcgacgccgccgtctcggcgatgcgcgagctgcccgtggtcgacgcggcgtgggacttctacttcggccggtacatcggttacggctgggagctcggctacgccccggacgacgtgttcggcggattcgcccagctctaccaggcgcgcgccgacgagctggcggagatgcgtgaggccgagccggacgacgagacgtcccggtgggacagccacccggcactctccgagcggatcgccgcgatgcgcgccgcgccccgcacctcgcacgtgaccgacggccggccggccgcggtgctggtgcccgcggtcgagctggccggcatggcgctgcagcgcgaggtcgtcgacttcggcacccggaccgtgctgccctgggccgacttcaccgccgcgtcgatggcgatgcgcagccagaaccgggccgatcgggtgttccgcagcacggcccggcacgccggcgtgcccgaggccggcctgcccgaggtgttcggcctggtcgaggcgggccggctggccgacctggccaccgagttcttcccgcaggcgacccgtcgggaggcggtcgccgagttcgccgacgtgatggaaaccctgctcgggctcgccgcggtccgctccggcacggcccgctggcagcactcctggtccggcccggcccggctggtcgaccagaccggccaggtgctcgacctcggcgagatcgccaagctggcggtggtgccggagacgctggccgaggcccgcgcccggctggccgagcgcggcgtgcacgtggaagcggcccgggtggtcgaggccaaggccaccgggcagggcgccgacgtgctcggcgcggtgccgaacgtgaagctcgacggcggcgagcacgccgacctgatcgtgctggaccgcggcctgatcttcgtgccggcgccgaagtcgaccgacgacggggacaagcgggtgggtgtgctggtcgcgcagaactcggcggccgacctggcggcgcgctaccggtacgtcgcgtacgaggaggtgtccaccgtccggatcgagaaggagacgccgatcggtgcgacgctgctgctgcatgacggccggacggtgaccttccaggagcgctggagctcggaccggatgggtaggagcgtcgacgtgctgcgcaagatcctcggggagctgcaggagcgcgcggaccgctagtctcggtcgcatgcggacgatcgactgggtggacggcgctgtcgagatcatcgatcagacggcgctccccggcgagctgcgggtgctgcgcctgcacaccgtcggggagctgatcgcggcgatccagtcgctggccgtgcggggtgcgccggcgctcggcgtggccggggcgctcggggtggcgctcgccgcccaggtgcacgccgacgatcccggggcgctggcgaacgccgtacgccggatcgaaaccgcgcgtccgacggcggtgaatctggcccgcggcgcgcaacgcgccgcggcccgtctgccgttcggaccggccgcggtgctggccgaggcctgcgtgctgcgcgatgaggagatcgccgcctcggcggcgcaggcgtcccgcggtgccgacctggtggccgagctgtgcggcgaccggccccggctgctcacccactgcaacaccggcggcctggccgcggtgaccgtcgggaccgccctcggcgtgatcggcgagctgcaccggcgcggcacgctgggcggcgtgatcgccagcgagacccggccgctgctgcagggcgcccggctgaccgcctgggagctcggccagtggggcgtcgagcaccgggtggcggtcgactcggccggcccgttcctgatggcccgcggcgaggtggacgcggtgatcctgggtgccgaccggatctgcgcgaacggcgacgtgatcaacaagatcgggacgtacgcgcacgcgctcggcgcccgccgggccggcctgccgttcctggtggtcgcgccggagaccacggtcgacaccggtaccccgtccggggcggacgtggagatcgaggaccgcggcgcggccgaggtgaccgcgtggagcgacgcggtcaacccggccttcgacgtcaccccgcacgacctggtcaccgcgatcgtcaccgaccggcgggtgatccggctggaccggggcgagaagccctaggagtccttcttccagggcttgagccacggggtctccggccagccctcggcggccgccatcagcgggaaggcggtcgccccgtcgatcgactcgcggatgatgtcggcgtgaccggcgtgccgggcggtctcctggatcaggtgcagcaggatccagcgggtggtgaagtggtcgaggtccggccggttccacggcaccgagtggtcgaccgggatccggtggtccaggccgagctcggcgaccgccttctcggtccgctcggcggcccggtcgtaccgcgcgaagagctcctcgaccgtctcgtcgccggtgagtacgaagttctcgtggtaggccgcgaagtccggcttctggctggcgccggtcgccgtggcgatccagccctcctcggtggagacgcagtgcttgatcagaccgccgatgctgagcgaactggcgctcgcggtggcccgcagctgttccggggtgagaccgtacgcggtcagtttgagcgtgtatcgcgcctgggtgagaaagctgagcagaccgtcctgctcaccgctgatgggtccgacctgaccgggcatgccgactcctgtacgtcgtggtttctccgtcgaaaaccacgctagaagccattgcggccagtttccggccgcatggtgttcaattccgtgccaaccacggcggtgacccagccgccgccccgccccagcgccagcagcgcccgcacgtcggcggtcgtccggcccggtgagcccggcgtcggcggccaggcccgccgcaactccccggccgccgccaggaacgggatcaggtcgccgccggccaggtcgtcgcgcagctggaccaggtcgctgatcacctgctgcagctcgcggagcacctcggtggcgttgcccgcacacatcgcgttgatcaactcggcccgggtggccgccacccgggtgccgtcccggaacgagccggccgccagcgcctgtctcagcgggctgcccgccagggtggtggccagcgccgcggccagcaggtgcggcacgtggctgaccgccgcgaccgcgttgtcgtgctccaccgcggtgatcggcagcacccgcgcgcccaacccggtgaagagcccggcgaggatcagccagtcggccggatcggtgccgtccggctccacacagagcacccacacgcagccctcgaagagcttcgggtcggcggcggcgaacccggacgcctcggtgccggccatcgggtgcccgccgacgaaccggcgcaccccgtgccgctcggcgagcgcctggaccggacccttgaccgaggtcacatcggtcagcacgccgtcgtaaccggccagctcggcgaccagcccgggcagcaccggcagcggggccgcgagcaccgtcacctcggtcccggcgaccgtggccgcgaccgagccgggcacggtcaggccggccgcccgggccagctcccgggtcgccgggtcggtgtcgaagccggacacctcgtggccggcgtcgcgcagggcccgggccagcgagccgccgatcaggccgaggccgacgaccgcgatccgcatgccgccgcccctcaggccttgcagtggtgcgacttgttccaggcggccaccgtgtcgaccgggctcttctgcccgttcccgcgccacgaggccaggaaggagtacggccagaccacgccacgccgcaccttccagtccccggtctgcgcgcacggcggggagatggcgtagtgcaggtggcagacgccgttcgcgttgccggtgtggccgaccctgccgatctgctgacccgacttgaccagcgcgccgggcacgatccccttggtcaccgagctcaggtgcgagccgtagtaccgcacgccgtcgttgccgaggatcgagacgaacaggccgccgttgtacggcccgtcgggcatgcccttcctgaacctgtcgaccaggctgatctccaggacccggccgttgtcggtggcgaccaccgtggagccgcaggcggcgaagatgtcggtggccgggtaggcggagtgggtgtcgtgccaggccacgttcgaggcggccaccgggaacgtgtacttcgaggtgaacatccaggccgggaccacccggggcgccggcgccggggccggccgcggggtgaccgccgccgacgcggtcgtcgcaccggccacggcgaggcccagggccacgatcatcgtcaacgcttttcgcaccgcgacatcctcgcagagacggatacgctgtgcgggtgcacggtctctacgccgggctgccaccgcgcccgatctatcgcgagccgcacccgatcggtgccggcccggtgctcagcggcctggcggccggcgcgctctggctgctgctgttcggcagcctcggccaggatctcacgtcgtacgcgtggtggacgatcggcgccgcggccgctgcctggctggtcgcgctggtcctgacccggctcggcgaccgcggggtggcgctcggcgtcgcctgctccagcggcatcggcctgtccgtcgcgatggggttcgtggccttccggtggatcgagacgttcaacttcccgctgtggtgattgccccggttcgggatgtgagttcggccacgatccgagaggtgccgatcgcccagcgcaccggttctgatcatgagccggccggcccttgacgaacgccgcccggctcggcactctcggcaccatggccacctcaccgcagcgtctcgacgcggatcgctgccgtcgccgactggaactgctggcggccctggcccacgccaaatcggtgcgtgagtcggcgccaccgcggcgggcccgcggcatgcgtctgcgcgagctgatcgccacccgtcgccgtaccacgaactgatctcgttgcgagaaagggcgtggcgcgtcacgcccgccgccccaccagctaccgtcaggcgctgaggataagaaccgcgttgggggaatcgtgtcgattttcgctgccgctgtcgcccgtggaaagaacgggtggactgcgtcggagctggacctttcgggcctggccgacatcgacgaggtggtggatgcgctccgggatgccgagccggacgccggactggcgctgctgttcgtcgagagcgacgacgagtacctcgcgatcctgcgcctcgacgagggtgaggacctgcgggtcttcgggtccgactcggccttcgccgaggagtcccggatcggctcggtgctgctcggcgaggtggagacgccggcgctcggcgccgacgacctgaccgccggcgacaccgccgaggacgaggacgaccgcccggccgccgacccggacgccgacccgatcggcgacgccgacctgctcaacgatctgggggtcggcgcccagcggctgctggcgctctgcggccaggagggcatgctgccgtccgacatcaccgccgagatctgccagaagatcgggtgcggcgacgagatggaggagctgcgcgaggcgtgatccgtcgcgagcggcacgagcggtggatgcggcgggcgctgtccgtcgcctcctcgtcgccggccgacgtcccggtcggcgcgctcgtcctggacccggacggcgccgaactcgccgcggccggcaacgaacgcgagctgaccggcgacccgaccgcgcacgccgaggtgctggcgttgcgccgggccgcggccgcgcgcggtgcgtggcggctggacggctgcacgctggtggtcaccctggagccgtgcacgatgtgcgccggggcgctgatcctggcccggatcggcacggtcgtcttcggcgcctgggagccgaagaccggggcggtcgggtcactctgggacgtggtccgcgacccgcgtctgacccatcgcgccgaggtctacggcggcgtgctggagccggagtgcgccgagctcatgcgcggcttcttccgctgaaaccgatgcggtggtacgtcgccgccggtgtccgccgcgcgtcatcgcgccccctgggagcccggcgccgcgacctctgccggtcgcggcccggtgttcctgctcccgccggcttcgggcccgggcgtggtgccggcggctccgggcccgggcgtggtgccggcggctccgggcccgggttcggtcaggcgatgatcgtgtccaggccgatccggaccatgttgctgaagccctgctcgcgctgcgccgagtccatcgcctcgccgcgcttgatgtggtcgctcacggtcaagatggtgagcgccttggcgccgtaccgggccgcgatcgtgtagatcgccgccgactccatctcgaccgccagcacgccgtactgggccagcgagtcgtacaggtcgggccggtcggtgtagaaggcgtcggcggccaggatcgggccgacccggatcgggacgccctgggcggcggccgtgtcgacggcggtgcgcagcaggccgaagtcggccaccggtgcgtagtcgacgaggccgtcgaagcgggtccggttcatgttcgaatcggtcgccgagccgatcgcggcgatcacgtcaccgaggttcaggtcgagcgccagggcgccgcaggagccgatccggatgaccgacttcaccccgtactcgttgaccagttcgtgggtgtagatcgaggccgacggcatgcccatgccggagccctgcaccgagacccgctgcccctgccaggtgccggtgaagccgagcattccgcggacctgggtgtagcagaccgcgtcctccaggaaggtctccgcgatccacttggcccgcatcgggtcgccgggcagcagcacccgttcggcgatctctcccggcttggccccgatgtgcacgctcatccgttgtctccgtctcgtcgatgatctcctgccgatcttgccaggtcacgggggtgccgggcggtaatgggtgacccggcgacggacacctcggggcgtccggtaacgtacttcccggtggtgtgtccgagtggcctaaggagcacgcctcgaaagcgtgtgagggtttacgccctccgcgggttcaaatcccgccgccaccgccattgagcagtgcaaacgcccggcgactcggagtgagccgccgggcgattttgtatctggtctcagttgctgcgtagtggtgcgtcggtgtgcctacggaagttgcgttcgccaagagttgaccttggcgtcataagagatgatcacagcgggtctgcctgcttcctcgccaagcgtccttacgagcaggcgcagagcggtgaaggcatctccgagctgagaaatctcccccgcaagatggtggtaggtggccttcccgtcgtgacttccggtgaaggcgcgcaggatgaggtcacctgcgtggagcgtcgagtccgctcgctggcgtttgtagttcccatccacgacttgaagagcggtaatcgtgtcggctcgaatgagctgaccgtcggtggtttcgatccaaagtccatcggtggctgtcactctctcatcgtgccctcagtgccgaacccgtctcaaccttcagaagcagacgacctccacagcagacgcggccaggccgccgcctctgtttgtcgcatcagggtttgaatgggcagccggcggacaccctgacgatctccaactcgccggtagcctgcttgcgtcgttgctcggccgtgggctcccagtgcgggacgttgggatcccctcccttgacaagccgttcgaaatgaacccggcagtccgtgccgtcggccgccttgccgctgccgctgccgacgaactcccacggatcgattgacaggctggccgggccagccgacgtggtcatctccggcgcagacacggcggcaagtaggcccggcgtcgaaggaccgacgtagacggcttggctgtagtagatcgtcgcccgctcgtgccctcgtatctcgatgctctttaggtacggaccttcgacgctgccgtcgtcacacgccgccacgccgagggtgaggatggcggagccgagaagaagcaaacgggtgatcacccaagcaccataagaagggtgatcaactcatgtcgatcgaagatccggcgggcgtggtctcagttttggtctcgttcgccgccgttcatggctgttcgctgggtctgtggatggccctccggtgctggatcgggctctcttgttttctcccgtcacatccgtcactctgtgtgccctgattccggatcgttcgcgcgtaccgcccccgcctagtccgaacgggcgttcaccatgatcagcggcggtcttgtaacgcggagatgtcgtcgcacgtcaaagccttgaaccacggtgtgtagtcaatcgtggacggcccagcgacatgaggtgttgcgcaagtcacggcggccaaatacaccggatcagacaatgcggttccgaccgggcggtgagaaagattcacagaaacgccccacccaggttcgtcgatgcctgtcgtagatttgacacgtgagagttgagcatcactggtggaatggcgacgtccggctccagcgccgggacgtcttcgtccgcaccgacggagaccattgggaagtcgaggcccagctgggcggtcccgaggggaaatcgaaggtgcagcagtgtcccggccgggcgtcagcgatgatcctggccgacgcgtggcgcggtccacgctggcagtggcgcgagctgtaaggcgcgccaggagcccgggctgcgccgtcgttgcttgacttgtctcggccagccttcacggacgggccggatcccacacggggtccggcccgtccgtgctttaccggcagttgaaccctcgggcagtcgccctttggggcgctttgtccagatatgcccggcggtccgtacggatctgctatatggcaatcagcgttgtgtcaagccgatgcacgacgcacgtcgagtccgatgtgcgcgattctgcgcaatctaccctgaatatccattcaccggtaggaagcgattgccatgcgggccaccatcaccgagcaccggcctgacgttgccgtgctgcaccttcgaggcgagctcgacgcggacacctccaacgagttgcgtgtcgtgctcgccgaactcctggaacgccccgtgcccaggatcgtggtggatctgaccgagctgaagttctgcgactcgatcgggttgagcaccttcatcatcagcaaagaggtgatcgtcgcccggggcggctggctcagtttcgcctcggccgatccgttcctgaccaagctgctgcggacggtcgggctgtcccggtacttcgcgatcttcccggaagtggacgacgcgatcgccgccggccagctgtaggcggggcggcgcggaaaacggcgagggccggcccgatcggggccggccctcgcctgcactgttttcgagccggagcatacgagacgcgacgaacgtctcacgcaacggcatcccctagtcacggcgcgcgcgagggcggcgtaggccgggtggaccgggtcccccggggcgcggcgtgcgggctcacggcgtacgccggcaatcggatcccggtcggtcctgaccgggcctggaaaaaccgaaggccggacccgagggcccggccttgtgcggcggaggatacgagattcgaactcgtgagggttttatcccaacacgctttccaagcgtgcgccctaggccactaggcgaatcctccgggagccagagtacgggggcgtaagttccccttacgcaccgggggtcggatgagcggggcggcgcggggcgggtaggctgacgatcagcccctcgtgcggcgtcatcctgtgaacctccccagggccggaaggcagcaaggataagcgggctctggcgggtgcacgaggggtcctttcgttccccccagaccggcacggttccggctcgcaccgtcggggcatgtcgtttgttcttgtcacaccctcgacggagaatggcgcggtcgtcaggaggtggcaggagtggctctcgccctctaccgaaagtaccggccgcggacgttcgccgaggtcatcggtcaggagcacgtgaccgagccgctgtcgcaggcgttgcgcagcggccggctcaaccacgcctatctgttctccgggccccgcggctgcggcaagacgtccagcgcgcgcatcctggcccgctcgctcaactgtgagcagggtcccaccccggaaccgtgcggcgtctgtgcctcctgcaggtcactggccaacgacggcaccggctcgatcgacgtgatcgagatcgacgcggccagccacggtggtgtcgacgacgcccgcgagctccgggagaaggcgttcttcgccccggccagcagccgctacaagatctatgtgatcgacgaggcgcacatggtctcgtcggccggcttcaacgcgctgctcaagctcgtcgaggagcctccggagtatgtgaagttcatcttcgccaccaccgagcccgacaaggtgctcggcaccatccggtcgcgcacgcaccactacccgttccggctgatcccgcccgccaccctgcggccctacctgcagcagctcaccgaggccgagggcgtcacggtcgagccggcggtcttcccgctggtggtccgggccggcggtggcagcgcccgggacaccctctccgtcctcgaccagctgatcgccggcgccggccccgacggggtgagctacgcccgcgcggtcgccctgctcggcgtcaccgacgtcgccctgatcgacgagatgtgcgacgcgctggccgccggcgacggcgccgccgcctacgagaccatcgaccgggtcgccgaggccggccacgaccctcgccgcttcgcctccgacctgctcgaacgccttcgtgacctgatcgtcctgcagcaggttccggacgcggccgccaaaggtctgatcgacggcccggccgaccagctcgaggcgatgcacgcgcaggcgtcccggctcggcgccgccaccctgtcccgcagcgccgacatcgtgcacaacggcctggtcgagatgcgcggcaccaccgcgccacggctcctgctggagctgatcaccgcccggatgctgctgcccggcgccgacgactccaccggggcgctgctccaacggctggaacgcctggagagacgaggcccgctcgacgccgccgggcccgccggggcgcaggccgcgcccgccgaggtacgcggtgacgacgccgcggtcgcgaccggctccgccgcgggtggggggccggtgctggacgggccggggggtgccaaggcggcggctctcgcccttgcgcggggtgctcggggtaaagccggtggtgctgcccgcccggtctctcccgctcccgcatccccggctgcggctcccgctgctgcggccccggctcccgctgctgcggccccggctcccgctgccgcggccccggctcccgctgccgcggctccggtcccggctgccgttcctgcgtcggtctccccggctgaggcggactggaaccgggtcgccgacgggccggccgacgtcgaggactacgacgacgcgccgccgtgggacgaggagcctccgccgccggtcgatcatgagccggtggtcgcctctgcgccgcttcccgccgagccttccggttcgcagcagccggcggcgggcccgaccccggcggttgcgccgcgggagcttcccgggctgccgcaggtgcgtaccgtctggcaggcgttcggtcccaagcacgacaagatccaggcgatgcagaacagcggcatcggcatccacgacgtcgacggttcccgggtcgtcttcctggccccgtcgcagcgctatgccgaccgcttcctcacctatcgcgaggtgatcatcgccgagttcaccaccgaactcggcggcgactgggacatcgactgccaggtcggcacccccacgccggaaaccgcaccccgcaactccccgccgcgcaccgccgcggcccccgcccggggctcggcaacaccggctcgcgaccagtccgccaccgcaccgcgtgaccagtccgccatccccccgcgtgaccagtccgccgcccgccgcgcggccccggagcggaacgccggccgcaccgagtcccgcccgtcccgcccgcagcgcaccccggccgacgccgacgacgacgggccaccagcggacgcgttcccgccggagcccaccgacgatccctacgccgagcccgcctacacgtcggctgtcggcggcaccgtcccgccggcgcccggcctccgggagcccgcgccgacgagacctgccggcgcgccgggcgatgccaccgtcccggcgctggccgtgcctggcggctccggcgtcagatccaccaccgcgccgacagctccccctgccatgccggcagcttcggccgccgcgcccaccgcttccaccgtcgcgccggcgaatgcggcggctgcctctcatgccgctccggtcagcggtgccccggcatcgcccgcggcacagcccgattccggcgggtcgtcgacaggtgtcacctccgccgcctctgattggccggagccggctcgtcccggttcgcgcccgtcgccgccgcccgccgacgatgactggcccgagccggtcaaacctggtagccgcgcacccgcaggcaactccggcccctccggatccgccacgaccgtcgagggtcaaccgaccgcaccggcttccgccgagcacagtgcggtcgggactccgtcccaccatgtagcgggccaggttcaccacgtggacagcagcggcgcggcatccggcggcccggctgtcgatgccgcggttggcggatcggcttccggtgccgtggtggggggatcggtttcgggagccgcggttggcgggtcgcattccggagctgtgcccgccgactcggatgacgagcccgcggataccggttcgccgtggcccaggccggccgcgcccgggcttccggtgacgatcgccgcccccgcggttcctgatgtggcccgtgccgcggctgacctcagcatgacggcgtcggcacaggcggccggcccggaccggaggacaccatcggctaccgcaaccgctgtgtcggcatccgccgccgcatccccgcccgcggtggcgcgtgccgcggcggcggtggagacgccggcggttgcccgctcggctgcgatggaggcggcgcgggccgctgcggcacgaagcgggaacgcgacgccgagcagtggtctggccgccgcgcgggcggccgccgctcgtggcgggggtggtgctccggtgcggaccgctgccggtccggggccggggggcgtcggcggcggctccgcgtggtcggacgggacgccgatcggtgaggcgccctacgaccccgagtacgacgggccgcccggcggtggtgccggctacgaggggttcgatccgggggacgagccgctggacgaggtcatcgacgagaagaccgcccgccagagcagcgaggagcaggccatgcagctgctgcgcgacgcgttcggcgccgagaagatcggcgagatgtagggcggccgtgcggccggagggggacgttcgcgcggcgtggtgggcggctgagcggggtatcggtgccgggcggctacgctggcggcggttgattcgccgggccggcggctattgacgacggttctcggcgacgagtgacgactacccagaggagcggtgccatgcgccccggtgcacagccgaacatgcagcagctgatgaagcaggcgcagaagatgcagcagcaggtcgctcaggcgcaggccgagctggccgaggcggagctgaccggcacggccggcggcgggctggtgacggtgaccgtgaccggtctcggcgagttcaaggccgtcaagatcgaccctaaggcggtggacgccgacgacgtggagacgctggaggatctgctgctcgccgcgatccacaacgccgctgaggcgcagcgggagctggccgagcagaagatgggtccggccaccggcggcttctccctgccggggttctgatcccgtgtacgagggtgccatccaggacctgatcgatgagctgggccggctgccgggcgtgggcccgaagtcggcccagcgcatcgcgttccacgtgctttccgcggacccggtggacatcaaccggctgtccaccgccctgcgcaaggtgaaggaactggtccggttctgcaccacctgtttcaacgtggcggagtccgagcagtgccgggtctgccgcgatccccgccgcaccaacgaggtgttgtgtgtggtggaggagccgaaggacgtcgtcgcgatcgagcggaccggcgagttccgcggcaggtatcacgtgctgggtggggcgatcaacccgttggagggggtcggcccggacaatctgaagatccgcgagttgttgctgcggctgggcaccggtgaggtccgtgagctgatcctggcgacggatccgaacaccgagggcgaggcgaccgccacctacctggctttgttgatcaagccgatgggtatcgcggtgacccgtctggccagcgggctcccggtcggtggtgacctggagtatgcggacgagatcactctgggtagggcgttcgagggccgccgcgcgctctgacgaaacatcgcgtaaccaggctgtaacgggatgccacctgtttggcctggattggccacttgcgaaccccttacgcggtaccttccgtttgttcagcgtctaggtcacggtgacatcacgagggagacacggaaacatccgcgtgcggtcagtgagcttgacccgggcaccgcactaggtgaatgttcctctcgatggcggccacacccgccatcgggtgccctcgtggtcccggcccgacatgggccggtcggccgatgggggccggcactcgaggcatgcgataaccgatcggtttaccgctcgcaacgtgggccatcgtctccgggccgtgggggtcttccgtgtacccacgcgccgggcggccgtggactctctgctgcgcggtggccgggagaggaccggcgaaacagatgtcgcttggcccagaagcgtcgatctctgacgacgctccgccgccaccggccgttgatgctgccgagacgcggggtcccgccgagaaggccatcgtcgggcgctccctcaagcagatcgcctggcgtcggctgaaacgggacaaggtcgcggttgccggtggcgtcttcgtcctcttcctgatcgccgtcgccttcctggcgccgctgctggccaagtggttcggtcacccgttcgacgagttccacggcgatcaggtcgaccagacattccagacgccgctcaagccgtggggcggcatcagcaaggacttcatcctcggtgtggagccggtgaacggccgggatgtgttcagccggatcgtctacggcgcgcagacctcgctgtcggtcgccttcctcgccgccttcttctccacgatcctgggcagcgtgttcggtctggcggccggttacctgggtggctgggtcgactcggtgatcagccgggtgatggacttcctgctcgccttcccccagctgctgttcgcgatcgcgctggtctcggtgctgccgcagtcgttcctcgggttcggcaaccgctggtcgcgggtgctcgtcctggtcctggtgatcggcttcttcggctggccctacgtcggtcgcatcgtccgcggtcagaccctgtcgctgcgggagcgcgagttcgtcgaggcggcccgcagcatcggtgcccgctcgccgcggatcctgttccgcgagctgctgcccaacctggccgcgccgatcctcgtctacacgacgctgatcatccccacgaacatcctcaccgaggcggcgttgagcttcctcggtgtcggtatcccaccgccgaatccgtcgtggggcggcatgctgtccgatgctctgccgttctacgcggacgatccgctcttcatgatcatcccgggcggcatgatcttcattacggtgctggccttcaacctcttcggcgacggcctgcgcgacgcgctcgatccgaaggctcggtaatcccccgcggatccacgcggctctgcatcagcccttgcatggtcggcggcgtcaccgccgttatcacacgaggtaggagaacaaggtggcaaataagacgaaggtgatggtggccgcggcggctgccctcacgctgggggtgaccgccgcgtgcggcggctcctccaagtcggacgacaagaagggctcctcggccgagggggcgggcttcaacgcggcggtcaccggggtggtcaacccgagtgacaaggccggcggcacgctgaacatgtggacgtcgcaggcgccggactcgttcgacccggcgatctcgtactacggctggaccatcaacatggcccggttcttcaaccggaccctgttggcctacgacgccaagccgggcaaggacggcctgaagctggttcccgacctggcctcggccgagccggagatcaccgagggcggcaaggtctacaccttcaagctgcgcagcggcctgaagttcgacgacggcaccccgatcacgtcgaaggacgtcaagtacggcatcgagcgcatcttcgcgcaggacgtcgtcccgggtggcccgctgtacctgcagcagctgctcgaccagggccagaagtaccccggcccgtacaaggacaccgacccgaacaagctgggtctcaagacggtccagacgccggacgactcgacgatcgtcttccacctggccaaggccgactccagcttcccgtacatgctggccctgccgggcggtggcccggtgccgcagaagcgggacaccggcgccaagtacgcgctgaacccggcctcctccggcccgtacatgttcgcgccgggcgccatccagccgggcaagagcgcgaccctgacccggaacccgaactgggacaagtccacggacccgatccgtaaggcgcttccggacaaggtcgtcctgacgatcaccacgaacgccgccgacatggacgaccgcctgatcgccggcaccgccgacatcgacgccgggcagagcggtgtgcagaccaaggcccgggccgacatcctgcgcgacccgaagctgaaggcgaacgccgacgctccgaacaccggcttcatccggtacgccgcgatgtcgaccaacgtcgcgccgttcgacaacgtggcctgccgcaaggccgtcatgtacgccgccgacccgaccacgctgcaggccgcccgcggtggcccggtggccggcggtgacatcggcaccaacatgctcccgccgaacatcctcggctcggacgtgaagtacgacccgtacaaccgggcgcagggcaaggcgcaggtcgaggaggccaagaaggccctgaccgagtgcggcaagccgagcggcttcgccaccaagattgcggtccggaacaacaagccggccgagatcgccaccgccaccgcgctgcaggcggccctcaaggccgtcaacatcgacgcctcgatcgagcagtacgacggctcgctcatctcgtccgtcatcggtgcgccgaacaacgtgcacaagaagggctacggcatcatgatcgccggctggggcgcggactaccccaacggctcgggttacctgcagccgctggtcgacagccgcttcctggtgccgaacggcaactacaacctgcccgaggtcaaggacccgtcgatcgacgggctgttcgaccaggccgccgcggagaccgacccgaccaaggccgccgatctgtacagccagatcaaccacaagatcatggacggcgcgttctacctgccgttcgtgttcgacaaggcgctcaactaccgcaacccgcggctcacgaacgtctacgagcactccgcgctcgccatggtcgacttccaggcgttgggcgtgagcgacggcaagtgagccgtcctgccggtaacgcaccaccaggtatctcgaagggcaggtgaaggccacctcccggtaggcgggtgccggttccgcgaggagccggcgcccgccgaccgttcggccgaacgtcgtgcttgcttacctcatccgacggctgatcaacgccgtcctgacgctgctcgcggtcaccctggtgaccttcggtgtcttcttcatggtgccgaagctcaccggtagtgacccggcgctgctgtacatcggcaagcaggccgaccccgtcgccgttcagggcatccgggagaagctgggtctcaacgacccggttctggtgcagtacggcaagttcgtgaagggcctcgtcgccggccgggactacaccaccggcgtcgaggtcacccactgcccggcaccctgcctcggctactcgttcaagaccgacgaggaggtctggccgaaactgctgggcgacctgccggtgacggtgtccctggcgatcggcgcggcgatcctctgggtgctgatgggcgtcatgttcggggtgatctcggcattgcgccgaggaacgttactggaccggacggtgatgggtgtcgcgctcgccggcgtctccctgccgatctatttcaccggtctggtcgccctgtcggtcttcacctacaaactcggctggctgaaggacgcggactacaccccgttcctggacagcccggtggactgggcccgcggcctgatcctgccctgggtcacgctggcgttcctgttcgccgccacctacgcccggctgacccgggcgaacatgctggagacgctcggcgaggactacgtccggacagcccgggccaagggcctcggcgagcgcaccgtgatcggcaagcacgcgctgcggtccagcctcacgccgctggtcaccgtcttcggcctggacctgggcgcgctgctcggcggcgcggtgctcaccgaggcggtgttcaacctgcgcggtctcggttacgaggcgctcaacggcatccggaccagcgacctcccgatcatcctcggcgtcaccctgttcgccgcgttcttcattgttctcgccaatctgatcgtcgacctggtctacggcatcatcgacccgcgcgtgcggctgggctgaggggaagcgaatgtcacgcccattcctcgaggtcaaggatttgaccgtccggttcgagaccgacgacggcatcgtgcaggcggtcagcgggtcgaccttcagcctggaggccggcaagacgctcggcatcgtcggcgagtccggctccggcaagagcgtcacctcgctggccctcctgggcctgcaccggacccgcagcaacgccaaggtcgccggcgagatctggctggacgacaaggaactggtcagcgcctccaacgaggaggtgcgggcgctgcgcggcggcaagatggcgatgatcttccaggatccgctgagcgccatgcacccgtacttcaccatcgggtcgcagatcgtcgaggcgtaccgggtgcaccaccccggggtgaacaagaaggtggcccgggagcgggccatcgacatgctcgcccgggtcggcatcccgcagccggcgcgccgcttccacgactacgcccaccagttttccggtggcatgcggcagcgcgcgatgatcgcgatggcgctggtcaacgacccgaaactgctgatcgccgacgagcccaccacggccctggacgtgaccgtccaggcgcagatcctggacctgattcgggatctgcaggaggagttcggctccgcggtcatcatgatcacccacgacctcggcgtcgtcgccgagctggccgacgaggtcctggtgatgtacggcggcaaggtgatcgagaagggcccggcggtggatctgttccagcgcccgcagcacccgtacacctggggtctgctcggctcgatgccgcggctggatcgcgaggtccgggaccggctcaccccggtcaagggcacgccgcccagcctgatcaacctgccttccggctgcgccttccacccgcgctgcccgtacgccggccgcaacggcgaccggtcgttcacggagactccggtgctgaccggcggggcccacgcggtcgcctgccacctgccgccggaggcgcgcgaaaagatcttccaggaagaagtggcccccaacctctgagcggggaagagagagaacgatgagcgagaacctgctcgaggtgaccgggctgcagaagcatttcccgatcacgaaggggctgttgaagcgccaggtcggcgcggtccgcgcggtggacggcatcgacctgaccgtgcaggccggcgagacgctgggcctggtcggcgagtccggctgtggcaagtcgacgaccggccggctgttcagccggatcctggagccgacggccggcaagatcgtcttcgagggtcaggacatcacccacaagtcggtcggtcagatgcggccgctgcgccgtgacgtccaaatgatcttccaggacccgtactcgtcgctgaacccgcggcacacggtcggctcgatcatctcggcgccgctgcagatccaggacatcccgacaccgcagggcctgaagaaggccgtgcaggagctgctggaactggtcggcctcaacccggagcactacaaccggtatccgcacgagttctccggcggccagcggcagcgcatcggcatcgcccgggcgctcgccctgcgcccgaaactgatcatcgccgacgagcccgtctcggcgctcgacgtgtcgatccaggcgcaggtcgtcaacctgctggaggacctgcagaacgagttcgacctgacctacgtgttcatcgcgcacgacctgtcggtggtccgccacatctccgaccgggtcgccgtgatgtacctgggcaaggtcatggagatcgcgccgcgcgacgagctctacaagaacccgcggcacccgtacacggtcgcgctgatgtcggccgtcccggtgcccgacccggtccggcgggaccgcgcgcagcgcacccgggtgctgctcaccggcgacgtgccgagcccgatcaacccgccgtccggctgccggttccgcacccgctgctggaaggcgcaggacatctgtgccacccaggagccgccgctggtggcgcggctcgacgacccggaggggcacctgaccgcgtgccacttcccgatcgcgcaggacgaggcggtcgccggtcgcaccccggcggcgacccaggcctgagggccaccgcacgattcgttcgtacgccgacggcaccgtccgcccgagccatcatggctcgggcggaccggtatcgatcacccctcggggcggttgagcagcccgacagcgatgcagtgcaccgcgtccaggtccgtggggtcggccagtttcgacctgcccccggtgaccacgtaccactcgtccgcgtccttgtactgcacgcggagagtcacctcgccgtccttcagctcggtgcgcagcgtgaggtcaccggtgaccacacccacctcgtcggtcatcaccccgcccggcccgggcacgatgtcggtcgtcttgctggcgcccgcgtcggcggcgggctgcgccgcgggcggccggagccgccgcggtgggctgagccgttgcggcggccggagccgccgcggtcggctgcgccgcggcagtggtctgcgccgcgggcttctctggggaatcggtcttggcttcggtcatcaacaggtctccagcatctccttcagagcgtccttctccttctggagcacggtcagcttgtagtacgccttcacggttacccagtcggtggcgtacgtgcaccactcggccttggccggcggtttccaggtggacgggtcctggtcacctttggaccggttggacgccgccgagaccgcgacgagctgtggccggtccaggtcgttggcgaacgcctcgcgctgatcggtggtccacttcgcggcgccggaccgccacgcgttggccagcggcaccacgtggtcgatgtcggcctggcccggtgcggtcagcgacttgtcgtcgtagacgctcttccaggtgccggccaccacgttgcagccggacttcttgaccttggtgccgtcgcgctccagcaccgagtcgcggacgtcgcagttcttgccggtgctcttccagtgcgggaacttctcccggctgtaaccggccatcgagccggccttgtcgacgacggtcaggccgtcgagctgcttgaccaccgagccggcggatgcgccggacccggtggtggcgtgggtcgtggtcgtggtgctgccgccgggcgagccggcgtcgacggtctggcaaccggcgacgagggtgacggtgagcaggagcgggagcagtgtgttacgtgggggcacccgctcagcgtaaggccggctgtcgcgtgccgcctcccggcggcacgcgaccgggtgactagcgggcgcggttgatcgcgctgttcaccgccttgatcgacgcgctgacgatgttggcgtcgataccgaccccccagaaggcgcggtcgccgacctcgacctcgacgtacgccgcggcctgggcgtcaccgccggaggtcagcgcgtgctcctggtagtccagcacccgggccttgatcccgagcggcgcgaccgcctgggtgaacgcgtcgatcgggccgttgccgacgccgaccagcggccgccgcatcccccggtggatcacctcgacgtcgatctccaccttgccgtccacggtggccgtgctgtagctctcgatcttgaaggcgctgcccagctggtgctcgaccaggtattcctgcgcgaagatgtcccacatctgctgcggggagacctcgccgccctcctcgtcggtgtggtgctgcaccacgccggagaactcgatctgcagccgccgcggcatgtcgagcttgtgctcctccttcatgatgtacgccacgccgcccttgccggactgcgagttgacccggatgaccgcctcgtacgtgcggcccacgtccttcgggtcgatcggcaggtagggcacgccccaggtgaagtcgtcgatcggggtgccggcggcgtccgcgtccgcctgcagcgcggcgaaacccttcttgatcgcgtcctggtgcgagccggagaacgcggtgtagaccaggtcgcccgcgtacgggtgccgctcgtgcaccggcagctggttgcagtactcgacggtgcgcttgacctcgtcgatgtcggcgaagtcgatctgcgggtcgatgccctgggagaacaggttcagccccagggtgaccaggtccacgttgccggtgcgctcaccgttgccgaacaggcagccctcgatccggtcggcgccggccagcaggcccagctcggcggcggccaccgcggtaccccggtcgttgtgcgggtgcaggctcaggatcacgctgtcccggcgcggcaggtggcggtgcatccactcgatcgaatcggcgtacacgttgggcgtggccatctcgacggtggccggcaggttgatgatcagcggccgggccggcgtcgggtcgatcacgtcgatcaccgcggagcagacctccagcgcgtactccagctcggtgccggtgtacgactccggggagtactcgtagaagatctcggtgtccggggtgtggatctcggcgtacttctggcagagccgggcgccctgggtggcgatgtcggtgatcccgtcccggtccaggccgaagaccacgcggcgctgcagcaccgaggtcgagttgtagaagtgcacgatggcccgcttggcaccgcggatcgactcgaaggtccggtcgatcaggtgctcgcgacactgcaccagcacctggatggtgacgtcgtccgggatcaggtcctgctcgatcagctggcggacgaagtcgaaatcggtctggctggcggccgggaagccgacctcgatctccttgtagcccatcttcaccagcagcatgaacatccgccgcttgcgttccggggacatcgggtcgatcagcgcctgattgccgtcccgcaggtcgacggcgcaccagcggggggtctgctcgacgacgcggccgggccaccgccggtcgggcagatcgatcgcgaactgtttctgataggactcgtaccgctggaagggcatcgagctggaacgctgcgaattctcggcgaaggtggacatgtgactgctccagtcagaaggaagacgagcaggcggcgcgtgtcaccaccgcgacggggtgccggcctgggaagaggccccgtcgcggcagagaaggaggaggttcgcctgccacatgtcgaccaccacgttacgtgatccacttcggggcggctaaccgaacgaccggatcgtgggatcgctcagccggccgcggccgacggcgcctgcaccgggtcggcggcggacatgcccatcgcggcgccgcccacctccgggccggggaactgcacggtcggcggcgcggccacctgacggaccagcctcagcacgccgaaacccacccgggccgcggtgagcatgccgtccggggcgtagcagtagacgccgacgtcgaccggcgcgtccccggaggcggcgttcgaatcgaccgagtagcacgccgagccctgcgtgccgtccagcggctgcgccaccgagaccgcgagggccgcgttgcggtcggtgaagaccggcagccactgccgcaacaggcgctgcacccgggggtcgtacggggccggcaccttctcgcccttggacgccacgtgcacgcagccggcgttgatcggcgcgccggacatcgagacggtgcactggtagacgccgttcgggttgtgcacgatcgacacgtccgccgagccgccgagcgcgccgttcgcgatgtccacccgccaggtgccgtcgttcgccacggtggccaccacgttgcgggcgacgccgtcgccgccggtgaacgaatagagcgcggcgtaccgccggtccatcgccagcgcggccatgccggccagctggttgcgggcgtccgggttcgggtcggtggacgcggacggggacgccgagccggtcggcgcggcatccggggtgtcgccaccgccgcacccggccaggccgaaggccagcagggcggcggtcagcgcggacaggccgcggacggatccggagggaaggcgcacggcgccattctcaccccattccgcccgtggaacgcgacacgccggacggtgtgcctcggcgtgtcgtgccggaacggccggattctgggatcgtctgtcgagcccgcgggcccacgcggctagggtggtggcgaatgccctgaaaggattggttggccgtggctctcgtggtgcagaagtacggtggttcgtcggtcgcgaacgccgagcgcatcaagcgcgtggccgagcggatcgtcgccgcccgcaaagccggccacgacgtggtcgtggtcgtctcggcgatgggtgacaccaccgacgagctgctcgacctggccaaccaggtgagcccgctgccgcccggccgcgagctggacatgctgctcacctcgggcgagcggatctcgatggcgctgctcgccatggcgatccacaacctggggtatgaggcgcggtcctacaccgggtcgcaggccggcgtgctgaccacctcggtgcacggcaaggcgcggatcatcgacgtcaccccgggccgcctgcgcaccgcgctggacgagggtgcgatcgccatcgtcgccggcttccagggcgtgtcccaggacaccaaggacatcaccacgctcggccggggcggctcggacaccaccgcggtcgcgctcgccgcggcgctgcacgccgacgtctgcgagatctacaccgacgtggacggtgtgttcaccgccgacccccggatcgtgccggacgcccagcacatcaagcagatcacctatgaggagatgctggagctggcggccggcggggcgaaggtgctgatgttgcgatgcgtggagtatgcgcgccgcttcaaggtgccgatccacgtacgctcttcgtactcgaacaaagaaggcacgctcgtcaccggctcgatggaggaccctgacgtggagcaagcactgatcaccggggtcgcgcacgaccgcagcgaggccaagatcacgatcgtcggtgtccccgacgagccggggtcggccggccggatcttcgagaccgtcgcgtcggccgagatcaacatcgacatgatcgtgcagaacgtgtcgaccgagggcaccggccgcaccgacatctcgttcaccctgccgaaggccgacggcccgaccgcgatgaccgcgctcgacaggatcaaggatcagatcaagttcaagagcctgctcttcgacgaccacgtgggcaaggtgtcgctgatcggcgccggcatgcgctcgcacccgggcgtcgcggcctccttcttcgcctgcatcggtgaggccggcgtcaacatcgagatgatctccacgtcggagatccgggtctccgtcgtctgccgcgacaccgacctggacaccgccgtccgcgccgtgcacgaccagttcgagctgggcggctcggaggaggccgtcgtttacggcggtaccggccggtaagccggacgatggggcggcccacgcttgccgtcgtcggagccaccggttccgtcgggaccgtcatgctcgacctgctctcgtcccggcgcgatgtctggggcgagatccggctgatcgcctcgacgcggtcggccggccggactctgacctgccgcggcgaaagtctccaggtgctgccaccctccccggaggtgttcgacggggtcgacgtggcgatgttcgacgtgcccgacgacgcggccgcacactgggcgccgatcgcggtgtcccgcggcgccgtcgtggtcgacaactcggccgtcttccggatggaagccgacgttccactcgtggtgcccgaggtcaaccgggaggcgctcgcccaccggccgcgcggcatcgtctccagcgccaactgcacggtcgccgcgatgatcatgtcggtggcgccgctgcacgacgagtacggcctgcgcgagctggtcctcgcgtcctatcaggccgcctccggcgtcggccaggtcggcgtcgacaccctgcacgaccagctcaccaaggtcgccggtgaccggctgctcgggtcccgcccgggcaacgtccgccaggccgtcggcgacgacctcggcccgttcccggccccgctcgccctcaacgtggtcccctggtccggcgacctcggcccgctcggctggtcctccgaggagctgaaactgcgcaacgagagccgcaagatcctcagcctgccggccctgaaggtctccgccacctgcgtccgcgtcccggtggtcaccggccactcggtcgccgtccacgccgtcttcgccgccgaggtcaccgccgacggcgcccgccaggtcctgcgcaacgcccccggcgtcatcctggtcgacgacccggaagccggcgagttcccgatgccgatcgacgccgtcggcaccgacccgtcctgggtcggccgcatccgccgcgccatggacgacccgcgagccctggacttcttcgtcaccggcgacaacatgcgcaagggcgcggcgctgaacacggtccagaccgcggaactcctggccgccgaactgaccacctagcccacgtagccgcccgtcaggtcactgatcccggcccggtccggtcggccgggtatgaagatcaactttaaaatcagggtcgttttttacgcgcatccgccggggtgcggatcgcatgctcccgcgcgggccgggccacggcgatctggccgctggcgcgtccagggcgatcaccgcggcccttcactgtccgcttctggtcgcggtcaaccccggaccggccccgtatgcccggcgaacctgcctgttctccggcccgcctcgcttccgaccccaccgtggcatggcgccttccccgggcggtcccatgcggtgcgcttgtctgggcggccccatgcggtgcgcttgtctgggcggccccatgcggtgggcttgtccggcggccccatgcggcgtccttgccggtaaccgggtgtggtgtctgctggcgcccggcctcgccttccagccgggtttcgtgcggctgtccggcggctgggtgcggtgctttcgccgggtgacccggtgtggtgcgcccgtgcgggtggccaggggtgatgggctgctgggcggcccggggtgtgtggcctggcgggaacccccgctgtccggcgacgtgcgcggccgggcatcaccatgcccgccgcccgaatcgcggacagccggccgtcgacgcacgcgcctcggtccgggcggtgcggcgggaccggtgtggtgtggccgtgcggcgggagcggcatgatgtggctggttccggtccggagggaccgacgacgtgctggtgcctacccgacgggtgggtggtttgcgggttgggatttctggggtggacggtgaccaagcacggacagtgaagggtgcggcgatcgccctggacgcgccagcggccagatcgccgggcccggcccgcgcgggagcatgcgatccggaccccggcgtaccggcgtatcggatgaatttgatcttgattcggggagatggcccgggcgtggatcacgcgaccccgcccgggccgtccgtcaggaagccgccgcgtccagatccgccctggtcagcagggcccggagggtgatgccggcgtcggcgagggcctgcgatcccccctcctggcggtcgatcacgcagaccgcgtggtcgacgtgggcgcccagcttgcggagctcgccggtggagatgacgacctggccgccggaggtgacgacgtcttcgacgaccagcacgcgccggccggcgacctcggcgccctcggcgaggcgggcggtgccgtacttcttcgcctccttgcggacgaaggcggtgggcagttgggcgtgccgggccagcgcggtgaccacggcgatgccgcccatttccaggccggccagcacctcggtgccttccgggatcaacacggcgagtcgctcggcgagtttgtcgaggaggaccgggtcggcctcgaactggtacttgtcgaagtattcggtggcggtgcggccggatcgcagggtgaattcgccggtcaggcggctcacggagcggacctggcgggcgaggtcgatggagtcagtcacaaggtcccagcttgtcaggcggcggcgtggcgacgcgcaggcaccccggtcgtcacccgttggcgtacttgatctccgcaatacggcattctatgtctgtttggggtacttttcgcctaattagcggcctttgttcggaaggaacatcgctgtgacgcccttcgccttgctcttcctcctcgccctggccggatcgacgtgcttcgcgctcggtcgggccttcggccgtggggagcgctacgagcgcggataccgcgagggattccgcgacggtgagaccgggtcgctggcccgggccacccggctgatgcaactcggtgaacggcagaccatcgcgccggtcgtggagaccatgctcggtccctactgcgtgccgcagcagatggcgccccgcccggtcggcccggcggtggccggagtgccggtccgcccgcagttcgccgtttgaccgcgaaggggttgacggcggttctccaccgcgccgcatcgctcggggtcccgccgatgccggaaagggccgatcgggcgtctgcggtccgttcaggccactcagcggtcgatcatcgaccgggccggcgcgggtgcatggtcgtcagtcaccacatggagaaggcccggttttccctgaggagaaccgggccttactgcaagctggtcggggtggcgggatttgaacccacggcctctacgtcccgaacgtagcgcgctaccaaactgcgccacaccccgttgctgcgttaagaatactagcggaccatccggcaggcccgaaatccggtacccccgtgcggtgtttccgcagctcaaggccgaggcgggcgacggcgctagctagctagccagccggccggggtcagcgggggatcagggtcaggatggaggcctccgggcggcaggcgaagcggatcggcgccgtcgggtgggtgccgaggccggccgacacgtgaagccaggcgtccgagcccggccaccggtgcagccccttcgccagccgggtgggcaggtcgcagttggtggtcagtgcgccgtacccggggacgcagacctgaccgccgtgggtgtggccggccagcagcagctcgaagccgtcggcggccatcgggtcgaggacccgggaggccggcgtgtgcgtgacgccgaggtgcaggtcggcgccggcgctgatcgggccggccaccgccgggtagtcgtcgcggtcgacgtgcgggtcgtcgacgccggccagctcgatcgagcggccgccggccttgaggatggtgcgggcgttgttcaggtcggcccagccggcgtcggtgaaggcggcgcgcaggtcgtcgtagggcaggtcggcgccctccacgtactctcgctcgggcagcacgtactgcagcgggttcttccagaccgggccggtgtagtcattggagccgaagacgaaggcaccgggcacgtcgagcaggggttccagggcgcgcagcacgccgggcaccgcgtacggcgaggccatgttgtcgccggtgacgatcaccaggtcggggtcggtgccgctcaggccggccacccactcctgcttgcgccgctggtcgggcatcatgtgcaggtcggagaggtgcaggatgcgcagcggttccgcgtccggttcgagcaccgggacgtcgaagcgccggagcgtgaacatgttgcgttcgacgagggcggcataggcgaacgtggcgccgccgacggcggccagcgcggccgcggcggaaataagggagcgcttacgcatgacggcaagggtagtttctccgtccatgggaacgctgaaagaccgcctgaacgatgacctgcacgccgcgatgaagtcccgggacgaactgaccacctcgacgctgcggatggccctgtccgcggtgcgtaccgcggaggtcgccggggacgaggcccgggagctctccgacgacgaggtgctggcggtgctgaccaaggaggcgaagaagcgtcgcgaggcggccaccgccttcgacggcgcgggtcgtgccgaccaggcggcgaaggagacggccgagggcgaggttctcgaccgttacctgccgaagcagctgaccgacgcggagatcgccgagatcgtgggcggggcgctggcggccggtggattcaccggtaaggcgcagatgggcccggccatgaaggcggcgcaggcggccgtggcgggtcgggccgagggcggccgggtggccgccgaggtgcgccgccggctcggctgatccccggaaacacgaaacgggcgggagatccgatctcccgcccgtttgccgtgctcggtgctatcgcccgggtttcgtggtgccgggcttcgggttgccctggttgcccttgctgatctggatggtcaccgcgccacccttgatcgtgcggtcctcgtcggtgcccgcggcggtgccggccgggcagtccgagtccacgctggggccctccaccgggtcgaagccggccagctcgatcttgtccttggcggtggagagcgggtcgcaggtgacgtccggcacgctcttcaggtcgccgatcgagatcttgtcgttgcccggggtcttgaactgaacgctcggcttgcccttcatgtagtccttgagcgtgtactgcaccgtggcgttgatctccgggtgggacatcgtgttgttgtggtcgggccagtccgggtcggccatgtaaccggcgacgaccagcgaggtggtgccgacgatcagcgacgcggtcttgctggcgtcggtggtgccggtcttgccgaacaccgggtggccgacgatgtcgtgggtgttgccggccgtgctgttgccgccgcagctgcccagctgggccgagtcgccgaccgggcaccgggccgcgtccagcgcggcccgcgccacgtccttggtggtggcctggatgcagtgcggcttgccgacgtcgatcttctcgccgtccttggtggtgatctgctcgaccggggtcggctcgcagtacttgccgtcaccggcgatggtggcgtacgcgttcgccatctccagcggggtggagtccatcacaccgagggtgaaggcgccccagttggccgcgttgttggcgttcttgatgtcctgcgtcgagcggaactggatgccgaaccgcttggccacggcgaccaccttgtcggcgccgaccttctgctccagcggcacgaagaacgtgttgaccgacttaccgaagccggtccacatgttgtagacgccggcctccttggtgctggagttgccgggacaccagtcgtcggtgccggggcaggcggatttctcgccgtagccggccgggtacttcgagtggaagcggaccggggcgttgatctggtagctcagcgggatgctgttctccagggcggcgaccatggtgaacatcttgaacaccgagccggcctggtaacccacgatgtcgccaccgccggtgatcagtgggttggtggtcttcgggaacgacccgcggatcttcttgcgcttcttggccgggtccggcgagatcttgttcgtcgggtggtccgggtcgtccagcgagtacttccggttggtggcgagcagccggaccttgccggtgccgggctcgacgccggccagcagcagcgcgtcctggctgctgtcggcctcccgctgggcgatctcggcgcgggccgaggcggtgccgttcaggtccatcgaggtgatcacggtgtagccgccgctcttgagccgccgctcgcggtcgtacgacgtggcgccgaacgcctcctggctcatccaccagcggtagaaatagtcgcagaagaagccccagctgttcttcgcgaccgagacgcagccgttgctgaccggcttcaccttggtcgggatcggctccttcttcgccttgtccgcgtcggccgggctgatcgcgttcatggcgaccatgccggggatgatgtagttgtcgcggcgcgcctggatctggtcgtggccgctcttcaccgtcgggttgaagctggtcggcgccttcaccatgccggcgagcatggacgcctcgccgatcgtcaggtccttcggcttcttgttgtagtagacctggctggcggcgtagatcccgtacgcctggttgccgaacggcgcgatgttgaggtagcgctccaggatctgctccttggagagctgcttctcgatctgcagcgcgtacttcatctcggtgatcttgcgcttcggggtgtccttggtggcgtcgatcacctcctgcgggttggtcgccgagtaggccagcgacatccgcacgagctgcatggtgagggtcgacgcgccctgctgggagtcaccctggctgttgctcacgaacgcgcgggcgacacccttgaggtcgacaccgttgtgctcgtagaacttgcggtcctcggcggcgacgatcgcggtctgcatgttcttcgagatgtccttgagcggcacgtcgctgcggaactcgtcgtagaactgcgagatcagggtccggccgtcggaggcgtagatccgggtgatctgcggggagctgaattctttgatctcactgggcagactcgcgaagcctgccccgcccgccttggcggcgaggccggacatcgccgccgcggggaaggcggcggccgccaccaccacgccggccagcaggccgcacacgagcagcgaggtggcgttcgtgaagatgttgtgatcgcgtctgcgcatccaggagctcacccgaggcaggatacgcgaacagtgcacgcgcctgcccgtcgagcaggtcgccttcgcccgttatgagtgtgacgcttcaccccgtccggcgaggcgatttacaacatctgcaccaaagatacccccgttcggtcaccatagcgcggccgctttgcccggaactaccggcctatacgtatttgagggacaacgttgcgtaatcacccaactacagagcatgatggtccggcgagacatctcgcatgacgtctgcgcggcatgaggggacatgggctgccgcgccggacgttcgggggtgaaatgcaaggggggacgtttaccaatggggatgatcagcgactggcccagcatggcggcgtgtcagagtggcgaccctgacgcgctgttcgtgcagggcgccgagcagaacgtggcgaagaggatctgccgcagctgcccggtgcgctacgaatgcctcgcggacgccctggacaaccggatcgagttcggcgtctggggaggcatgacagaacgggagcggcgtgccctgctgcgccgccacccgcacgtggcgagctggcggaagatgttcgaggccgcactgaaggagaagggcgccgacaaggtgctcgtctccacccgctgatctgtttgttcaggcgagtccgtcagttcaggcgagaagagcgcctatcgttcgcagcccgtcgacgtcgtggacgtcggcgggctgcgccgcgaccgaggtcgtcggcacctcggggaacgcctcggtgaagcccgccgcgacccgcacctcccgctcgctctgccggagcaggccggcgtggatgcgcagcacgtccgccgcgagcggggcgtccgccgacagctgctgcgccgccgcgagcgaggcctccgcggacaggccggccggctcggtccggtgcatccggttgagcaccagcccggacagcggcatccgctcggcgaccagccgctcggcgaagtacgccgcctcccggatggcgtcccgctccggcgccgcgaccagcaggaaggcggtctgcgggtcctgcaggatccggtaggtctggtcggcccgctgccggaagccgccgaacatcgagtcgagcgccgccacgaaacccgacaggtcggtcagcaactgggcgcccagaatcttctgcacggcccgggagaacagcccgaacgacgcggtgaccaggctgaacatgctgcggccgccgcgcgccggagcgagcagcatgcgcagcatccggccgtcgaggaagcgggacagccgggccggcgcgtccaggaagtcgagcgccgaccgggacggcggggtgtccacgatgatcaggtcccactcgtcgccggcccgcagctggcccagtttctccatcgccatgtactcctgggtgccggcgaaggtggagctcatggcctgatagaacgggttcgcgaagatctcggcggcgcgctccggcttggtgtgctgctcgaccacctcgtcgaaggtgcgcttcatgtccagcatcatggcgtacagcccaccgccctcgatgtccttgacctgccgcggcgtgttgttcagctcggtcaggcccatcgactgggccagccggcgggccgggtcgatggtgagcaccacggtgcggcggccgtgcacctcggcggcgcgcacgccgagggcggcggccgtggtggtcttgccgaccccgccggagccgcagcagaccacgatccggatggccggatcggcgagcaggccgtcgatgtcgagccggggagcggtcacgtcaaccaccacttcagagtagggcgtcggtcatcagccggccggccaggacatccaggccggcccggtccaccccgtcgggcagctggggcagctcgatcatcggccggcgccggtcggtcaggtcgtggcgcagggactcctccagctcccgccgggtcaggtgggcctgcgcctcggcggccagctgattgacggtggccggggtggcgggcaggccggccgccaccagaccgcgcttgatctccgccttggtcacccggccggcggccagcagcggtgggcgggcgccgttcaggatgatccggccgaccgggatgcccaggccggtcagctcgtcgaccgcgtccagggtctcctgcaccggcatctcctccagcagcgtgaccacgtgcaccgcggtcatcggcgaacgcagcagcgaggacaccccgtcgctctgggtcttgatcgggcccatcttggccagccgggcggtttccgcggtcacgttcaggaagcggccgatccggccggtgggcggggcgtccaggactaccgcgtcgtacacccggcggccgtcctgcgaccgggtggtggcctccttgaccttgccggtgagcagcacgtcgcgcaggccgggggcgatcgtggtggcgaagtcgatggcgccgaccttgcgcagcgcccggccggccgcgccgagcttgtagaacatgtccaggtattccaggagggcctcctccgggtcgaccggcagggcgcgcacctccccgccgccggtggtggtggcgatccggcgctccgcatagggcagtggctgcagcccgaacagctgcgcgatgccctgccggccctccacctcgaccagcagcgtgcggcggccgccggcggccaggcccagggccagtgcggcggcgacgctggtcttgccggtgccgcccttgccggtcacgatgtgcagtcgctccggccagttgccgtgatgctcgcccatgtcgtccacgttacggcgttcggtaaatccggctcagccggagacgtcacagaccagccagccactcttgtgcacgaccgtgaactgcaggtcctgagcagcggttttctcgtcctcggtggacatcaccacacggacgccgacctcggcctcactgccggtgccggcggtcaccgcggggtcgtcccagcggaagccggcaccctcgtaggcgtcggcgtagtcgcggatctgctgcacccgttcggcgagcttggcccggtcccgggacctgcggcagaccaggtcctcggcggcggtcgcgtcgtgctgggtgtagacggcggtgaggaaccggttgaccgcggtggccgggtccggtgagccgggcaggtcggcgtcccggaacatcacgtacgccgagaccgcgccgccgccacagagcgccagggtggcggccagcgccacggacaggaagatcgtcgagcgccgggaccggggcgtacgggcgatcggggcgggcggcgtgctcacccagatcggctccggctcgggcggcggcacctcggccggtggggagtgctcccaggccagatgctcgggcgggggtgccgccattcgccgggtttctcgtgccgggcgtgccacggcccctccgggggtggctggtgccagccgccgaccaccggatgttccatcgtggccgcctccgggagggcgtgccggccgcgctccggctcgggctccgtcacgtcactccccgcactggctcgtgtgctttccgtggcctttcccgctcagcctaaccaaccggtcggttcgccgggtcctaagctgtgccggtacccgacgaaggagtgtccgagccatgcagaagtgggagtacgtgaccgtgcccctgctggtacacgcgaccaagcagatcctcgacaactggggcgaggacggctgggagctggtccaggtggtaccggggccgaacccggagcagttgatcgcctacatgaagcgggcgaaatcgtgaccacgccgatcgccggcgacggtggcgtggacgcctacgcgaaactggccgagctgggcctgaccctgccgaccgtggtcccgccactggcgtcctacgtgccggcggtccagtccggcaatcatgtgtacgtgtcgggccagctcccgatggtcgacggcaaactgccgcggaccggcaaggtcggcgacgaggtgaccgtcgagcaggcggccgagctcgcccagatctgcgccctgaacgcgctggccgcgatcgaggcgctggtcggcctgggccggctcgtgaagatcgtgaaggtgaccggcttcgtcgcttcggcgccgggcttcaccggtcagccggccgtgatcaacggcgcctccaacctgttcggcgaggtgctcggcgagcaggggcggcatgcccgcagcgcggtgggggtgaccgagttgccgctgggcgcgccggtggaagtcgaggtcatcgccgaggtggcgtgatcttgggagggttcggccgggtttgatcacccaaggtgaccggaacggacatcgtgtctcggctcaccgtgaaatcgcgacgtacgattctcggcatggggggtgctgagcccgcgtcggctgaggtcgaccggctgccgggttgggtgtcgctgttgcgcgcccccaacccgggcccgatgaccttggacggcacgaacacctggattctgcgggcacccggcgccgacctggcgacggtgatcgaccccggtccgctcgacgaggggcatctacgccggatcgccgagcggggtccgtatcgatcgatcttgatcacgcacggtcatcatgatcacgtggagggcgccgcccggctcgccgggatgctgggcggtgttccggtccgggcggccgacccggagcacggtgcgggtttcgacccacgcgggagcctcgacgggaacggactcgaaatacaggtcctgcagactcccgggcacaccggcgattcggtgtgtttcctcgtcgggtacgggggtgagcgggtgatgttcaccggcgacacgatcctgggccgcggcaccacggtggtggccgcgccggacggcgacctgggctcctatctcgcgagtctggagctgctcacggcgtacgaaagcgtcccgatgttgcccggccatgggccggcccgcagcgacacagcggccctggcccgcgactatctgcagcaccgcagggagcggctcgcgcaggtcagagcggcgatggccgccggcgcgcggaccccggaagcggtggtcgacctggtctatccggacatcgacccgcgggtgcggttcgccgccgagtggtccgcggccgcgcagatcgatcatctgatccgggaatcagcggcgggggccgacggtttggaccggctgtgacctgccctgtgtgtggcaccgtcgccgttcccggtgcgcgcttctgtcaccactgcggcgcggcactgccggctgccgccgcgatgccggccgccgagcgccggatcgtcaccgtgctcttcggcgacctctccgacttcacctcctggtcggaggacctggacccggagcgggtcggcgcggtcaccgaccgggtgctggcggcgctggccggggcggtcaagacgttcggcgggcacgtggacaagctgaccggcgacggaatcatggcggtcttcggcgccccggtcgcccacgaggacgacgccgaacgggcggtccgggccgcgctgagcatgcagcgcgcggtccgccgggtgctcgacgacgagcgtggcggtggcgcgccgctcggcctgcgggtcgggctgaacaccggcgaggtggtcgccggcatgcaggccggcatcgaatacacggtcatcggcgacacggtgaacaccgccgcccggctggccgacgccgccgcggtcggcaccgtctacgccggcgagcggaccagcaacggcacccggcacgtcgcctcctggcggcagctgcggccgctgcggctcaagggcaaacgcgaaccggttccgacgtacgagctgctcggcctgcacgacgccccgggcacccggtccggcctgggcgacgaggcgccgttcgtgggccgcgaggcggagctgggccgggtctccggccggctggccgaggcgatcgacgccggcgccccacgggtgctggtgatgaccgccgaggccgggatcggcaagtcccgcttcgccggcgaggtgaaacggctggccgccggcttcgaggcgggcggcgtccgggtcctgcgggtgcgctgccgggcgttcggcgagcgccgccgctacgcacccctggccgacctggtccgcaaggccgccggcctgcccaaggacgtggtcgccacggtcggccgcacggtcgtcgaggagcgcctgcgcaaggtcgcccagcggctcggcgtcaccctggacatcgaccggctgctggttctgctgggctacggcgaggccccggtcaacccgggcggcccggccgcgcccgccgactggccgccgagcgccaagcggatcgacgccgaggccatctcggtcgcggtcgccgacctgctcaacgcgatggccaccagctcgccgctgatggtgatcgtggacgacctgcacgacgccaccgccaccacggtggacgcgttgggcagcacgctgtcgcagctggagggcccggtcgtggtgctgctgctgggccggcccgagctggtccgcaccggcgcgctgagccgggtcgccgacgccgaggtgcacaacctgccgccgctgcgcggtgcggacgcgtcccggctgctcacctcctatctcaacggcggcaagctgccccagccggacaccgaccggttgctggccaccgcccagggcaacccgttctatctggccgagatggtcaccctgctgatggagcgcggcgcactgacccccgcggtgggcgccaacgcggccggcaagtggcagctcgccgccggttcgctcggcagccagctgctctcccgcgacctggcggcggtgctcgcggcgcgcatcgacgcgctgccggccgagccgcggtcggtgctgcgtgacgcgtcggtggccggcaccaccgtgccgaccggggtgctggaggcgctgcaggaacgccgcgcccccggggaggacctcgagccggccatcgacgagctgctgcaacgccgcatgatccaccgcagccggggcggcttccagttcaccaccccgctgatgcgcgaggcggcctacgccgggatcggcaaggccgacctggccgagcggcacgcccatctggcgacctgggccgcgccggagacggtcggccggcacgccgacggggccacccggctgcccctgaccgacaacgagcgggacgccttcgtggccgcccatgccgaggccgcgatcgagctggccgacgcggtacgcctgcgaccggacgcgaccgcccgggaggtggccgccctgggccgggccgcgctcggccggatggcccggcgtgcgctggccaacatcgagccggccgccgccatcgagtacgccgagcgtgccaccgcactgaccggcaccgacctgccgctgcccgaccaactcgtcctggcccgggcgatgctgcggctgggccgggccgaggaggcgctggcgtatggggagaagatcaccaagagcgccgccgaggacccggtctgccgggccgaggcgatgatcgtggtcggccgcgcgcacgaggcgctgggcgacggcggccgcgccgtggccgcctggcaggaggcgctggaggtggccaccgaggcgcagctgctgccggagcgggccaacgcgatgcgccggctcggcatggccgacttcctcaacgggcggctgagccaggcgagcagccggttcgccgccgcctaccaggtcaccctggccgccggcgaccggcacggccaagcctgggcgctgcagaatctcgcctgggtgaccaccacccggggcgacttcgccggcaccgacgcggtgctgggccgggccgcgcggctcttcgccgagctcggtgacccggtgggccggtcctggctgcgcggcaccacggcgttcgcccggctgctggccggccggctgcaggaggcccgtcggctggcccggatcttcctgcccttcggcgaccgggtcggcgagggctgggcggtcggcacgctgcgggtcgtcgaggcctatgcggcggccgagctgggcgacctgggcgcggccgacagccaggcccgccgggcgtaccgggagttccaggaggtctccgacgactggggttgcgggctggcgatggtggtgcgcggggcgatcgcccgcgggctcggcgagttcgaccacgccgccgacctgctcggcgacgcgctctggttcgccgaccggaccgggcacccgctgctgctcgggatggccggcacgttgcacgggttcgtcgcgctgcagcagggcgacctggccaccgcggaggccgacgcccgccgggtgatgaccgcggtggagccgcacaactcgctggcgccggcccaggtcggcccgcgggtgttgctcgccgaggcgcggacccgggcgggtgacccgcagaccgcgatcggcctgctcgcaccgatcgccagcgacacgtcgtccccgtcgctgctgttctcccggcggcacgcgctcgcctcgtacgcgtcggccctgctcgccgacggccgggtcgagtcggcgctgacctggatcgaacgcgcccgtgaggtgcccgccgaggacgtgcgcagcggggtgatcgcggcgatggtccgggcccgggtgctggccgccgccgaccgctgcggggaggcccgcacggcggccgaggacgcggtccggctgtcccgttccaccgagcagaccagtgagcgcgcggcggccgcggagctgcgggacactctcgcgatcaccgaggtggaggcgactccggcggaaactgtcgcgtacgcgtctgacgtgcccggatgatctcccggtccgctggcgtattttctaagccgtgacggagacaccgcctggcgccctgcccgtgccatatgtcccgggtatgtccggcttgtcggtcatggcccgtgggggatacgcgaccgtttaccgggccacccaggactccgtcgggcgcgaagtcgccatcaagatggagaacaggaccctcgacaacgctcgtgaccaggcccgattcctgcgggaggcgcgcgcggccggccgcatgtcgtcgcacccgcacgtggtggacctgttcgacgtcggtgtcaccgtcgaccagcacccgtacctgatcatggagctctgcgacgggtcgtacctggaccggatgcgggtccgcccgctcaccgccggcgaggcccgcgacgtcggcgtgaagatcgccgacgcgctggtgcacacccacgccaacggcgtgctgcaccgcgacgtgaaaccggccaacatcctgtattcgcagttcaacgcggcggtgctggccgatttcgggctcgccgtgctcggcgagatgcgcgactcctcggtcaccctcgaagtgctcaccccggcgtacgcgccgcccgagatgttccgccatgagcagccgtccggggccgccgacgtctactcgctgtgcgccacgctctacgccgtcatgtatggccgtccggcccgctggcccagcgatcgcagtccgagcctgatcagcctgatgaacctgttcgacgagccgatcccggagctgcccggcgtgccgcgggccctgaccgcgctgctgcgccgcggcatgcacaacgacccgcggggacgtccgtcggcgcaggagctgctccaggagctgagcaacctgcagctcgagccgggggcgccgcagcagaacgtctaccggtcgacatccacctatgtgccgccgccgcgaccacggccgattccgccgacgacgccgacgctcgacgaaaccccgacggtcgcgaccgaccggaagggattcttcgccaagtggttcagccggtgaccgatcaccatccagcctgagtacgccctgagcccaccgcgtgcccgtgccaccccgccgccgcgcctcgcgcgccacggtcgggcgaggcgcggcggggcgctgacgggggacgggcgtgcggcttacccgtacgaaataaggggatatttctactctgggtcgagaaccgcgagcagctcgccggtggccacctcggcccccggatgcaccggaagcgacgccacgacgccggccgatggcgcatggacggggtgctccagcttcatcgcctccagcgtcagcagcagctccccggcccggacccgttggccgggaacgaccagtacgcgacggaccgccccgggcagcggggcgatcagcgagctctcgccggcctccggcgcgggcagcgggaagcgggagatctcgcgcagcgtcaccgacccctcagggctgtcgacgtaggagacgtcgccgacccggtgcacgaggaccgcgaggcggatgccctggacgttgagcaccacccggtcacggctggccgacaccaccacgatcggcgggtgctcgtcgaccggcgcctgtccgattccggccaggtccagctcctccgggtcgaccggccggacccaccagccggcgagttcgccgtgccggttcatccggtagccgacctcgaccgggccggtcgggccgtcgtagaccgcggtctgcgagccggacgggacgttgcgccagccggacgggagagtgcccagcaccggcgcgctggcccgccgatcggccgccccggccagcgcggacgccaggcaggagagccggaccgcgtcgaccgaggagagcagcggggcgaacacctcggggtgccggtcgaggaagccggtgtcgatctcacccgcccggaacgagtgatgccgcagcgtgcggaccagcaggtcgcggttggtcaccacgccgtgcagctgggcgcgggccagcgcggaggccagcatccgggccgcctcctgccgggacggcgcccaggcgaccagcttggcgagcatcggttcgtggtgctgaccggtcaccgagccgtccgctacccccgagtcgaggcgcaggccgggctgcggcagcgggcggaacgcgccggccacgtccggcaccgcgaaccggtgcagggtgccggagctgggcagccaggcgtacgccggatcctccgcgcagatccgcacctcgatggcgtgcccgcggatcggcggcgggccgggcatcggcaggctgccgccctcggcgaccagcagctgcagccggaccaggtcgtacccggaggtgcactcggtgaccgcgtgctcggtctgcagggtcggggtgagttccaggaaccagaagtcgccgtccgcgtcgagcaggaactcgaccgcgccggcgccgacgaagccgagcgcccggaccgcgacgatggcggcccggcacaggtcctcgcgcagcgcggcgtcgaccgccggtgacggggtctcctcgacgatcttctggtagcgccgctgcacggagcactcgcgctcgccgaacggcaccaccgcgcccatcgcgtcggccaggatcggcacctcgatgtgccggacgttgggcacgtacggctcacagaacacgtcgccgtccacctcgcggcgggtcgacgcgaccgcctcggccagcgtcgcggcgtcccgcaccacccgcatgccggcgcccccgaggccggtgtcgggcttgatcaggaccgggaagccgggcaccgtctccgggtcggtgaagctgggcagcaccggcaccttcgcctcggccaccagcttcttggtctcggtcttgcggtgcagggtgcgcagcgtcgcggccggcggaccgacccagatcattccggcgtcgctcaccgcggcggcgaactccgggtcctcggccagcatcccgttgcccgggtgcaccgcgttcgccccggcccgcttggccgccgcgatcagggcgtgctgttccaggtacgtcgcggccggggtgctgccttccaggtggacggcgtagtcggcctcgttgacgtgcggagcgtcgctgtcgacgtccgagtagacggcgaccgtctcgatgccgaccaggcgacaggtggcgaacacccggcgagcgatctcgccacggtcggccaccaagagacgtcggatcacgggtctacctttcaaggtcggaacacgccgacgtgttcggcacccgccacggcggcgctgtgcactgcggacaggcagaggccgaggaccgtgcgggtgtcgcgggggtcgatgacgccgtcgtcggccgcggcgcgatccgccgggggacgcggccagctgaactggaaccggggctggtcggcgcgggccggggtgccaccgggctccggaccgacggtgaggaccaggtgcggcaccgtggatttggcgatggcatgcaccaggggggcatcgttgcggacgtcggcgtcgtcgctgcccttcgtctcaccgggatgccgcagaaagatcaccggagtggcggtggcgttggccagctgcaggaaatgcaccgccttctgggattcggtgggagacagccagatgcccgggctggccagcacgccgaccgggtaaccgtgcagctcgccccagccggccaccagcacgctgccctggccgggtttgaactcgtcgaagtcggagtcgtccaggatccgggcgagcacctcgcgcggctcgaagttcgagccggccgcggccaggctgagcagggcctccgagctgtaccgtggctcgcgcggctgacggttgcgcggcgccgggccctgcttgcgccagttgaaccggcgcacgcactgccgggccaggcgcagcccgtcccgttcgtcctcggcgagctggtcggcggggccggccggcccggacggcaccaccggggtggcccgcacctcgacaccggaccgctgcggatggatggtgagcaccttggcgtgcccgcgcaccacgatcgtgtagtccgagagcgccggcaggtacgccgcgtcgccgctggtggtgccgaacaccacgcagacggtcggcacccggtcggcggtcagccggctcaactcccgggcgatgctcccggccggggccgcgtcaccggccgactcgaccaggttgaccagcggcaaccgattctccgaggcgatccgcgcggcccggcggatcttttccgcggtgtacgggttgaccgccccgccgtccaccgtcggatcgttcgcgaccaccacgcattcgacgccctcgaccgcgccgatcccggtgaccacgctcgccccgaccgggaactccgagccccaggccgccaccggggacagctccaggaacggactgtcctgatcgagcagcatctcgatgcgttcccggggcaacagtttcccccgggcgtggtgccgggtcacccatttctcgccgccgccggcgcgcgcctcgtcgagggcgacctccagcgcggcgagccattgcagggtggtgccgcgaccctccaggtatgcggggtcgcgcggatccagcgtggtgtcgagcacggtcacgccgacaccccgatgcccgctactcgcctacctgcgtccaatgccgcgcccttccgtgtcccgccggtgcctctcggccacctccgtaacgagtggccgtgcgggcgcgacacggaccgggctggcgagccacggtcaccgggaagagtggatcaagcacgtttgaggggctgcccggcaggacagcccctatgacgtgaagcggggaaggtcagacccgggcgcgccgggcgagacgctccggatcgaggatgatgacgctcttgccgtccagccggagccacgcgcgggaggcgaagtcggccagcgccttgttcaccgtctcgcgggacgcgccgacgagctgggccagctcctcctgggtgaggtcgtgcgtgacgcgcagcacaccaccgtcccgggtgccgaaccggccggccatctgcagcaggtttttcgccacccggccgggcacgtcggtgaagatcaggtcggccagcgcgtcgttggtccgccgcaggcgccgggccagcacgcggagcagctgctcggcgatctccggccggttgttcagccacgggcgcagcgacgacttcttcagccgggcgagccggctgtcggtcaccgcggtggccgtcgcggtgcgcgggcccgggtcgaagagggacagctcgcccagcatgtcggacggtcccatgatggagacgaggttctgtcgtccgtccgccgctcgtcgaccgagcttgatcttcccggacagaacgatatacaggctgtcgccggcctcgccctcgttgaagaccacgtcgcccttgcggacttcgatcgtgtccatctccttggcgagcgcctcggcggcttccgggtcaacgccctggaagatcccgctgcgcgccagtacctcatccatcgccgcacctccgaaacgcgcaacgtctgcgctcgatcagtctaggcgcacgcgggcgggaaacgggcggccaccccttgatccagatactgggcggtaaccaagtttgccttaaccgtcggtgacaattcgacgggacgggcagaatcggacggcactttcgtcggtcgcttccgcttgcaggccgacggtatcgtcccggtcgatgaattcgcaccccccgacccaccgcgacagcggatctgggcgatatgccctctatataaccctggtcggcgttgtcgtggccggcgccgccatcggcgggtatgcgctggtcaaccgggggaccgaggccgacgcgagctggcagtcgccggcgccgaccagggccgcggctgcccggaccgaatcgacccgcgcggcggcagccgccaccgcggtcaccttctcggccaccggcgacatcatgatggccaacgcgccgggcggcctgccgccgaacaacggcaagggattcttcgacccggtacgccgcagcctcgccgccgacctggtgatgggcaacctggaacagccgctcaccgaggacaccggcacctccaagtgcggcaccccggcccgggccaactgcttcgcgttccggtccccgccgtcctacgcccaggtgctcaaggccggcggattccagctgctcaacacggcgaacaaccacgccaaggacttcggcccgaccggcaaccggaacaccttccaggcactcgacggcgccggcctcaggtacaccggcgcgcaggaccagatcaccgtggtcccggtcaaaggcctcaaggtcgcggtcgtcggcttcgcgccgtacgccggtgtcaacaatctgaccgacctgacccacgcccgcagcctggtcgccaaggcccgcagccaggccgacctggtcgtggtgcaggcgcacatgggcgccgagggcccggcaatgaaccacgtcaaaccgggcagcgagatctacttcggcgagaaccgcggcgacccgatcaggttcagtcacgcgatgatcgacgcgggcgccgacctggtgatcgggcacggcccgcacgtggttcggggcatggagttctacaaaggcaaactcatcgcctacagcctcggcaacttcgccggcggcgggcacacgctctccaaggacgggatcctgaagtacgccgggatcctgcgcgtgacgctcaacgccgacgggtcgtacgccggcggcaccttcctctccacctgtctcaacgccgacggcctgcccacccgggacgccaccgcggaacacggccgccggctgatcacccagctgaccgcgaccgacttcccgacgaccggagcgacgatcggcggcgacgggacgatcaagccgtccgcgtgaccgatggtgcgggcggggcgacgtactctgtatcggtgacccgaccccgtcccgcgcccgccgaccccgggacggccgtgctggcgcggtcgacgaaacgcttcgccggggagacgccgatcgggcgcaaacgccgggcccacaggatggcccgggtgctcgccgacacccaccccgacgcgcactgcgagctcgacttcaccacgccgctccaactggcggtcgccaccatcctgtcggcgcagaccaccgacgtgcgggtcaatcaggtcaccccgcttcttttccagaaatatcggacagctgccgactatgccggcgccgaccgggccgagatggagacgatcctccggccgaccggcttcttccgggccaagaccaactcgctgatcagcctcggggaggagctgctcgccacgcacggcggggagctgccgcggaaactcgacgagctggtgaaactgccgggcatcgggcgcaagacggccaacgtgatcctgggcaacgcgttcgacgttcccgggatcaccgtggacacccacttccggcggctcaccaaccggttcgggtgggtcgacgaagaggacccggtcaagatcgaattcctggtcgcggagctgatcgagaaacgcgactggacgatgctgtcgcaccgggtgatctttcacgggcggcgggtctgtcacgcgcgcaagccggcctgtggggcttgcacactggcggcttcctgcccgtcctacggtctggggccgaccgaggccgcgccggcggcgaaactgctgaagggcccgcgggcgcgcgacctggcggtggcggccggtgtcgacccggacctcgtgccggtgggtgccgccgtcgagcccgactcggaggcgttgtgaggcttctggcgccggtcgcgatcgcggcgctgctgctcagcgggtgcacggccgccgcggtgaaggagtcgcaggccccgtcgccgttcgccgcctgcgcgccggccaccggcggcagcaccctgcccgacatcacgctcgactgcctgaccggcgacagcccggtgcgtctcgccgacctgcgcgggcccgccgtcctcaacatctggggctcctactgcggcccgtgccgcgcggagctgccggtcatccaaaaacttgcggacaccggcaagctcaccgtgctcggcgtcgacaccggcgacacccgggccgcggcgatctcgttcggcaccgaccacggcgtcagcatgcccacgctgttcgacccggaccgcaaactcgtcgcccagctcggcgtgatcagcctgcccagcaccatcttcgtcgacgccaccggcaagatcttcatttaccggtacgccatggacgcgcccgccctgaccgagcaggtggccaagcacgccggggtcacggtgacactatgagccggggcgagctgctggaccggccggacgacctgccggagtggttcgagccgctgctcacccgggtctccgagatccgcgccgaggatttcagcacgctgcgccgcccgtccgggtccggtggccggtccagtgccgtgctggtcctgctcggcgccggcgagtccggtcccgacctgctgatcctgcagcgggccgcgagcatgcggaaccacgccgggcagccggcgttcccgggcggcgccaccgacccgtccgacgccgacgcggtcgccaccgcgctgcgcgaggcgaacgaggaggtcggcctcgacccggccagcgccacggcgctggccctgctcccggagctgtggatcccggtcagccggttctcggtcaccccggtgctggcctggtggcgccggccacatccggtgctgtcccggcagcctgaagaggttgaccacgtcgcccggctgccgatcagtgaactggcggaccccgcgaaccgtatccgggtgcgacatccgagtggttggatcgggcccgccttccaggtccgcggactgctcgtctggggtttcactgcgggggtgatctcggttttgctggacatggcgggctgggcgcagccgtgggagccgggtcggatcgtggaactgccggacgccgcggccccggtgccggccgcgcgtggcggcgcacccgatgaggtggtgccgtgacgtgcgcgtgacttctatgttgagtgagtgcccgtggtcgatgtcatcctgatcgtgctgatgctgctgttcgcgatcagcggctatcgccagggattcgtgatcggggcgctctccctcggcggcttcttcagcggcgtgctgatcggcctccagctgggcccgctgctggccaagcagttcgctgacggcacggtccgcatgatcgtggcgctcgcggtgatcctggccctggccgtgctcgggcagaccctggcgggctggctcggcaccagcctgcgcaaggcgatcttcaaccgcccgctgcagcatctggacgacgccggcggcgcggtggtctcggtggtcgccgtgctgatggccgcctggctggtggccgtgccgatgggttccaccccgttcccggcgctgaacagggcggtccgcagcagcgccatcctcggcggcatcaacggtctgatgcccgagcaggcccaggcgctctcttcggcgctgcgcgagacgctggacaccaacggcttcccggacgtcttcggtggcctggcccgcacccaggccaaggaggtcgccgagcccgacccggcgctgaagaattcgaagatcgtccagagctcgaagcagtcggtcctgaaggttctcggcgccgccccgagttgctcgcgccgcatcgagggcaccggtttcgtctacgccgacgagcgggtgatgaccaacgcccacgtggtcgccggcacccgcgacgtggtcgtcgagaccgcccgcggccagctgaccggcaccgtggtcgtctacgacccgaaacgcgacctggcggtgatccgggtccccggtctgaaggccccggtcatgccgttcgtcagcaagaaggccggctccggtgcctccgcgatcgtcctgggctacccgcaggacggcccgtacaacgcccagtccgcccgggtccgcgacgtcggcgacatcaccggccccgacatctacgagtccggcgacgtgacccgcgagatctacaccatcaagtccctggtccgcagcggcaactcgggcggccccctgatctccccggacggccgggtcctcggcatcatcttcgccgcggccgccgacgacaagaacgtgggcttcgccctgaccgccgccgaagccgcccccatagccaaactcggcctggaaagcaccgagggcgtcaaaaccggcgggtgcgcctgaccccgtcctgtccccgctcctgccgcccgccacatcccgcggcgcccagacccttcccggcaccgctcccgcacgtcgccgcccgcctgcccggccgtctgtccgcctgcccggccgtctgcccgcccgcctggccgcctgcccggtcgcctctgcccggccgtctgtccgcctgcccggccgtctgtccgcctgcccggccgtctgcccgcccgcctggccgcctgcccggtcgcctctgcccggccgtctgcccgcctgcccggtcgcccggtcgcctctgcccgttcgcctgctcaggccgggcgcctgccaacccggccggctggtcgcccgcccggctgccgccgggtcgagtacccggtggggcgccgaggtcggaccgagcttgtcgctgagccagctttcgcgcccgcaatccgccgacacggtccgccgccctgatgtgtgcctcgcaaccacgcgtctgcgccccgcatgctgcggctccgcgccgagtccttaaggcgcttgctgcattcaacgccgttcgcgcgctccgtggtgccgtgttcggcgcccgcgtggtcggcccctcgccctgcccgccgccctgctccttcgggcttgcggtgccgccgttgcccgagcgggtgtgggctgcctccggtgcggccggtgggacggccgggagctcagccggtggtgagtgcgaagcggcggatggtgagagcgccgaccgcggtggagagcgcgaacaggctgatggcgatccaacggccgcggtgcggggccggctgggcggtcgccttggcggcccagccgccggcgttggtgccgggggcggcggccagcggctggctcgacgggtcgtcggtgggggcggactgcgcctcgccggaggcgggcgcgctgccgaggcggccgacgccgaccggcggcgtggtgtccagcgggttccccaggacgctgggcacgctcgcggtcagcgcgccggtggggtcgatcaggccgaaaccgaacacgtcgtcgcggccgggggtgccgcggtccttcgcggtgcggatgatccggttgatcacgtcgccggctgacatgtcgggccagcgggagcggatcagggcagcggtgccggcgaccatcggggcggcgaagctggtgccctggacccgccagtatccgccgggccgggcgccgaccagctcggtggcgggtgcggtgaccaccgtctccgggccggtgatcgaacccgaccagaggtcggtgccgttgcgttccatgccggccaccgcgaggacgccgggctcgcgggccgggtaccagacgctgtgggcgctcgaggtggcgctgacgttgccggtgcaggcgaccaccacgacgtccttggcgaacgcgtagtccagggcggcggccagagccgggctgttcgcgctgccgccgagcgacaggttcaccacccgggcgccgtggtcgaccgcccagcgcagacctttcgccacgatcagcgcgtcgtcgtagcgattcgcctcgtccagcacgcgtaccggcaggattttggctttgggggcgatgccgaccacgccggtgttgtcgtcgctgcggccggcgatgatgccggacaccgtcgtgccgtgaccgaccgggtcggtgtcgccgtcgtccttggggttgaccaggtcgagaccgggcagcacctggccgtccaggtcggggtggtgcgcgtcgaccccggagtcgatcaccgcgacggtgaccccggagccgtcggcgtaggtccacgcgtcatgcaggtcgagggtctgcagctgccactcgtcggcccggacggtgtcctctacggcggtgcccggctcggcgagcggccggccctcgaccacctcgtcggcgaacccgggctccgcgagcggccgcctcgtcaccgcccgccgggaaaccgccgggaccgcgagcgaccgggccgccgcggagcgcgcggaaatcgccgggaccgcgagcgaccgaaccgccgcggagcgcgcggaaaccgccgaggccgcgagcgagcgggccgccgcgggacgcccggaaaccgtcagggagatcgcggagccggcacccgacccgccaccgggcaccggagcggcgaacaccgccgggcgcacagcggcgaaggcgggcgccgccgccggcgtcatcacgaggaaaccggccagggccgcggccccgagatgccggaccgtcagcaacgcgcaccgccgaagggtgcacgacaccgcggccgctgcggccggatggttgcgctcactctggtcacgggtcggcgtcgccattctgatgatggtcagtcgatggggggagattactccgaaacagttgcgtgtcgctgcggtccgaggtccctaatcgcactgagagtctgtcccgggcccggattccggaagtgccagctgaataaggcgaattccctcacgccgagtgatcagacgaccacgccccggtggcagcggaccgggtcgcacgctgccgatcagcgcgccctcctcgggcgctccggacatcaccagacccggcgcggagagctcccggagccgctggatgaccggctcgtagagcgcccgcccggcgcccccggctcggcgggtgaggatcaggtgcagcccgatgtcccgggcctgcggcagatattcgagcagcggggtcagcgggttgaccggcccggcggcgaccaggtcgtagtcgtcgaccaggacgaacagctccggcccggtccaccaggagcggtcgcgcagctgccgggcggtcacctcgggcccgggcaggcgtttggccatgtatccggcgaccgaccgcatcaggtccagggtgggttgggcctgcatgccgtacccgatccggtgctcggtctccggcaggtccatcaggctgcggcgatagtcgaccaggatgatccgggcctgctccggggcgaaccgggcggtcaccgtaccggccaccacccgcaggaacgtcgacttgccgcactcggcgtcgccgaacagcaggaagtgcgggtcggtggcgaagtcgacggtgaccggttccaggtcggtctcggccagcccgatcggcagccgcagcccgtcgccggcgtcggcgatcccggcctgcgcgaccaccgccggcagcagccggacctggggcgcggccggcccgggccaggccgcggccaccgccttgaccagctcggcggtgtcgcccagcgaggagacctcgggccgcgcggtgagcaggtgcagccactgctcgcggacgccggggtgttcgatgacgccccggccgggctgctgctccgggaccgtgcccgcggcccggcggctcaccgacgagtcggtggtgtcgcccagccgcagctcgacccgggagccgaagaggtcgcgcacggccgggcggaaatccatccagcgggaggcggcggccaccaggtggatgccgtaggacaggccgcgggtcgccaggtcggtcagcaccggctccagctcctcgaagtcggcccgcaccgtgctccagccgtccaccaccaggaacacgtccggcccgccgcgggaccgccggaactcgcccatcgagccgacgccgagctcggcgaacgagcgctcccgtgcggccagcagggtgaccatttcgccgaccgtgcggcgcaccccctccgcctccagccgcccgaacaccccccccacgtgcggcagcccgcgcagcgcgcccagcgacccaccgccgaagtccaggcagtacgcctgcgcctcggccggggtgtgggtcagcgccagcccgcagatcagcgagcgcagcgcggtcgacttgccgctgagcgtgccgccgaccaccgccacgtgcccggcggccccggcgagctgcagccagagtgtgtcgcgcacctgttcgcgcggcttgtccaccagcgcgatcggcacctgcagggcgccgtgcagctcggggctgacgcaggtcaggccgcgcccggcggccacgatcggcgggcccagcagatcgtcgagggtggccggggagtccagcggcggcagccacacccggtgggccggcgggccctgtccggccatccggtcgaccagcacaccgagcagcgtgggcgagccgctggccggctcgggtgcggcgatcgccgccgggcgggccggggccgccatggcccgcgtcgtgtagggcagaacgcgcagctcggtcgtcccggccgggtcgcccggcgagccggtgcggcgcagcggcccggacacgtacgacccgcggaaccgggtcaacggcccgttgccgaccttcaggtatgcgtgcccgggcgcgctgggcaggtcggccgcgtccgggacgcccagcaccacccgggactcgacgctgttgaaggtcttcaggccgatccggtacgacaggtgcgtgtccagtccccgcagccgcccctcctccaggcgctgactggccagcagcaggtgcacgccgagcgagcgccccacccgtccgatctgcaggaacatctcgatgaagtcgggtttgtggaccagcaactcggcgaactcgtcgacgaccaccagcagcgacggcaacggtggcagggccgccccgtccgcccgggcccgctcgtagtccggcaggccggcgaagttgcccgccttgcggagcagctcctgccgccggagaagttcgccgtcgatcgcctcggccatccggtcgaccagcggcagctcgtccctcaggttggtgatcagcgcggcggtgtgcggcagccggtccagcgacgcgaaggtggcgccgcccttgaagtcgatcagcaccaggttcagcgactccggggagtgggtgccggcgagcgccagcaccagggtgcgcagcaactccgacttgccggagccggtggcgccgatcagcaggccgtgcgggcccatcccgccctgcgccgactccttcagatccagctcgaccggcaggccgtcggcggtcaccccgatcggtgcgcgcagccggtcccgggccggccggggccgccagccccgggccgggcggaagctctcggggtcgccgatgcccagcagctcggcgaagccggtctcggccggtaccggcggcccgtcggggtcggccaccccggccgtgcggagcggggtcagccgccgggcgatcgcctcggcggtggtcgccggcaggccgtccgcccgcccggccacggtctccacctccatggtggcggtgagcagcgtgccggtccggtccacctcgagcgccagggtggcccggtcgagcagccggggcggtggcgcgtccaggtccagcacggtcaccccgtcgatgccgtcaccgggtgggagcggctcgccgccgtcccggacgatcaccacgtgcggaccggccgcgctcgccgcgccgggctggaaccggggacggtcggcgagcacgtcgtggagcagccggtccagctcgccggcatcgccggcgaccagccggagcgggccgagcgggtcggagcgggccgggtgcagcgcgtgcggcagccatttgacccattcccagtcggcccgccgggcggggccggcgcagaccgcgaccagcaggtcgtccggcgcgtggaagaccgcgagctggatgatcgcggcccggaccaggtcccgggccgcttcgccgccgcgcaggtggacccgggcgaacccgcgcagcgacatggccaccggcaggtccggcacgaccgagtaggcgtccaggaaccggcgcagcgcgcccgcggtcaccggctccagctcgtgcagcgggcgggtggccggcgccagcagcggggtggccagggcctgcgggccgaggccgacccggaccacgccgaagtccgggtcgtccggccggcgctcccagacccggtggctggccgccgtggaccacagccggtccgggtcgggatggcgatacagctggccggcgcgctgccggcgggcggtttcccggacccggcggcgcagcacggcgaggtgtcgcaggtagtcgcggtgggcggcggcggtctcggcccggcggggtccggtggccgagccgaaggaggtggccagcatggcgatcgaggagatgccgaagaggccgccgatcacgtacgaatacatgccgccgtgaccctggcccatcatcatcgccatggccaccgtgccgcccagcatcggcaacaccatcagggcctgctgccaccgcccggcggccggccgggcccgctccgggggcggctcgaccagcagctcaccgtccgggatcgcgggcgccggacggcgctcggaccgcttgatcaccacggtgcccatcgcgtgcgctcccgtcgctcaccgtgcctcgccgatcacggggcatcacgaagcgcccatgctaggtaaagttcggggcatcgcgcagcatcgatcttcgtcgctgtggacaaccgtcggagggggttcggtgcggaccggtctggcccgggtgacgatcagcaccccacgacgccgggtggacgtggcgctgccggagcgggtcccgctcgcggaactgctgccagaggtgctccggcacgccggcgaggacctggccgacaccggtgagcggcatggcggctgggtgttgcgccgcgtcgatggagccaccctcgaggtggggcgggggctgcacgcacaaggcgttcgcgacggcgaggtgctgcacctgagcccggccctggacgactggcccgaactggagtacgacgacgtggtcgaggcggtggccgagggcgcccggcggcgcggcggcgtctggaccgcctcgaccacccgggcggctgctctcggcgccgccgggatcgcgctgtccgccgggctgctgacgctgctcgccggcccggtgcgaggaggcggcccggcgcgtggcggcgggggcgcgggctggaccggtctcggcctggcagtcgtcctgctgctcgccgcgacggtggcgtcccgggcgtaccggatgcgcccggccgctgtcgtcctcggcggttttgccatggcgtacgccttcatcggcgccgccgccctggtcgtcggcgcccatccggccggcccgctgcccgccctctagctagctagtgctgcggtcccggctgttccgggcccggcggctgcggttgccgctgatcgccggtggcctggccgcgctcgccgcgctgggcgcggatctgctgggccgggtgggcagcgatgtgctgccggtcgcggcggcggcctgtgtgctgctcgccctggccgtggtgccggccgggacgatctggtcgcagcgcccggccgggccgctgtcggcccgcgtcgcccacctgttcgaactgctggtcaccgccgcggtgatcccggtcgcctgcgcggtcgccggcctgtacaccgcggtcagcggcatctcgctctagcccgcagagctgttcgatccgtggccccggaagacgggatggccacacgaccgcacctgcggggccggagcctcgcaggtgcggtcgtcagcggtgcagcgggaagcgagcggtcagtgctctccctcggcctcggcggcctcggcgcgcttgaaggacgcgcggatctcggcctcggcctcgacccggccgacccaggtcgcgccctcgaccgacttgcccggctccaggtccttgtagaccgtgaagaagtgctggatctccatccggtcgaactcgcccaggtggtggatgtcgcgcaggtgctcctggcgcgggtcctcgaagggcacgcagaggaccttgtcgtcgcggcccttctcgtcggtcatccggtacatgccgatcgcgcgcgcccggaccaggcaaccggggaaggtcggctcctggatcagcaccagggcgtccagcgggtcgccgtcctggcccagggtgccctcgatgtagccgtagtcggcgggatactgtgtcgccgtgaagagggtccggtccagccggatacgaccggtcttgtggtccacctcgtacttgttgcgctgccccttggggatctcaaccagaacgtcgaaatccatgattcgctccccttttgcttgcccgcctgaatagaccggtccgccgggcgggaagcgggggagaggaagcaggcccgcaggatccgcgcgcaacggtgtgccggatgtcgctagtctcccctaagtctgacgccacgggcgaggaggggcgtgtgacgaggcaagattcacagaacggaccggagtacaacggcgtgtctaacgggacggatcgcccggatgccggtaaatggcagccggccgcgccggatccggcgacgacggcgcagatcccggctccgggggcctacccgccgagcggcctgccgcccgcgccgcccgcggcgtccacgggtgacgcgtacgggaaagcctccgtgccgttgaacaccgcccgcccggcggtcccggctcccgcaccgccgccgcaacccgccgcggccccggaacccgacgcggagccggcggcgccggacttcttctcgaacccgaagatggcctcgatcgtgctcgccgccgtggtgctgctcgccgtggtggtcgtcggtgtggtggagaagcccggcccgatcgccggctggttcggtgactcggcgagtccggccggcgtgaccaccaccccggacccgaaaccgaccccggtgctggccgccgccgcggcgcaggggacggcgccgaacccgaccgcggtcaaggccgtcctggacccgctgatccggtcggcggcgctcggcggcaaggtgcacgtctcggtcatggacgtggcctcgcaacaggtgctctacgcgcagaacgcggacatcccgaccaccccggcctcgaccgcgaagctgctcaccgcggtgaccgtgctggccgcccgcggcccggcgtaccgcctgaccacccgggtggtggccggcgcgaagccgggcgaggtggtgctggtcggcggcggcgacccgaccctggcggtcaacgcgaaggcggagttccccggcgcggcccggttggatcagctggccgcccaggtgaagaaggcgatgggcgccaccccgatcacccgggtgacggtcgacacctcgctgttcaccggcccggagaccgggctcggctggtcacccgacgacgtctcgccggacgggcaggtggcgcggatccaggcgctgatgaccaacgccggccggatcaccccggtgcaccacgagaacggcggcgacccgcggttcgccgatccggcgctggccgccgggcgggcgttcgcgaacttcctcggcgtgccgtcggagaaggtggccaagggcagggccccggatgccggcaccgagctcggcaaggtggattccccgccgctggtccagatcctcgactggatgctgcaggagagcgacaacaccctggccgagacgatggcccggcaggtggcgatcgccgcacacaaggaggccagcttcgacggcgcctccgaggcgatgatcgccaagctgcgcgagctgggtctgcccggcgacgaggccgacctgtacgacggcagcgggctgtcccggcacgacggcctcagcccgaccctgctggtgcaggcgctggcgctggcggccggcgggacgagacccgagctgtccgcgatgttcgacgggctgccggtggccggctggtccgggacgctgcgcacccggttcgtcacgcccagcccgaaccgtgccgcccagggtgtggtgcgcgccaagaccggcacgctgagcggggtgaacacgctggccggggtgctggtcaccaaggacggccgggtgctctccttcgcgatcatggcgaccggcacatcgaacgcggccagtgccaagaccgcgctggacagggtcgccgcgaaactggtggcctgcggctgttcctaagggtttctccggagtgcggtgtggagtcgcgcgggtactgtcggctgcatggcgcagttcgttgactgggatctggccgccgcgaccgccggcgcgctgtcgaaatcggggccggcggtctcctatgacgaggccgcccaggtggtcgccgagctgcgggtgctgaccgagcaggcggccggccacgtggcggcgtacaccgggctcagcgcgcaggtcgacgcgccgccggtgcgggtggtcgaccgccgcgactgggcgaaggcgaacatcgccggcctccggcaggtgatcaatccgctggtcaccaagctctccggggacaggccgccgggcgcgttcgccgacgcgatcggttcccgggtcaccggcgtgcaggccggcacgatcctggcctatctgtccggccgggtcctcgggcagtacgaggtgttctccgacgaccccggtcagctcctgctcaacgcgccgaacatcgtcgaggtcgagcgcaagatcggcgccgacccgcgggacttccggctctgggtctgcctgcacgaggtgacccaccgcacccagttcaccgcggtcccctggatgcgcggctacttcctgggccaggtgcaggcgttcgtcgacgcctcgcagggcggtgatcacctgctggagcgcctgcgccgtggggtggccggcctctccgacgcgctgcgcgacccggagagccgcgtctcggtgctcgacatcgtccagactcccgggcagaaagccgtgctggaccggctcaccgcgctgatgaccctgctggagggccacgccgagttcgtgatggacggcgtcggccccgaggtgatcccgagcgtcgagtcgatccgggccaagttcaaccgccggcgtgagggcggcaacccgctggacaagacggtccgccggctgctcggcatcgaggtcaagatgcggcagtacgccgaggggcacaagttcgtgcacggcgtggtcgagcgggtcggcatggagggcttcaacaagatcttcgagtcgccgctcaccctgcctctgctggaggagctcggcgacccggacgcctgggtggcccgggtgcacggccctcgcccggtcctcgactgaccgtggcccggatcccggcgccggtcgccgcggtccgcacggcggtccgtcgcggcctggccgacctgccgcccgccgcgctggtgctggtggcctgttccggcggcgccgactcgctgtcgctggccgccgccgcccggttcgtcgccgcccgggtcggtctggtcaccgtggaccacgggctgcaggagggttcggaccgccgggcacgatcggttgcggcctgggcgcgcgccgccgatttcgatccggtacgcgtgtgcccggtcaccgtgaccgggctgcccggaggccccgaggcggctgcccggaccgcccgttacgaggccctggaggccgccgccgccgagaccggggcggccgcagtgctgctcgggcacacccgcgacgaccaggccgagacggtcctgctggcgctcgcccggggcgccggcccgcgcggcctgtccggaatgccggcccgccgcggggtgttccggcgcccgctgctcgacgtgtcccggtccgacacccgcaaggcgtgcgccgccctcggcctggctgcctgggaggacccgcacaacaccgatccggcgtacgcccgtgcccgggtccgtgccaccgccctgcccaccctggtggccgagctgggtccggccgtggtcggcaacctggcccgcacggcgacgctgctctagctagctagcggcgctggccgcgctggccggcgcgatccgcggccgggtgctgcaccgctgggcgctggagctgggggcacccggcagcgccctggcgtactcccacgtgacctccctggacgcgctggtcaccggctggcgggggcagggcccggcgcatctgcccggcgggatcgcggtggggcggcaaggaagtgacctcgttcgggtggttcccgccattatcaagtgagcgaaccggagcgaaagtggccccgtttcacgaacggtaacctcgatgcggcaggctagagccatggctgatggctcttggtacgacgccgacatcgaccacgtgatcatctcggaggagcagatccgcgagaagatcgatgagctggcgaagcaggtctccgtggaccacgcggatgccgccgacggcatcctgctggtctgtgtgctcaagggagcggtcatgttcatggccgacttcgcccgttcgctggggcggcacgggccgtccaccgagatggagttcatggccgtctcgtcgtacgggcagggcaccacctcgtccggtgtggtgcgcatcctcaaggatctggaccgggacatcgccggccggcacgtgctggtggtcgaggacatcgtggactccgggctgaccctgtcctggctgatgaagtacctggagtcgcgtcaaccggccagcgtcgaggtggtcgcgctgttccgcaagccggacgcggtcaaggtgcaggtgccggtccgctacgtcggcttcgacatcccgaacgagttcgtggtgggttacggtctggacttcgcggagcgttaccgggagttgccgtacgtaggcgtgctccgccccgaggtgtacgcccgtagctgaaccgctttctcagcgtgttctcagtaatggtggttatgaaccgttttattactgaaacgcgccggattgcggggggttacgtggagctcgccctctggcctcacgggttcgcaatccgggcctacggtgtacggtcgagtgaccgacggcgtggtgtcacaggcgccggagggccgggagggttcaccgcaagccagcggggaattgataccggcggccgccggtgggcggcgacgttgaggtgaccaggacgccgatcaggagggtccgggcgcttggcgcccgacaacagtatggaacgtacgcgtttcttccgccgcccggtggtctggatcattctggtgatcatcggcgtagtcgcgctgagctcattcttcaccagtggtcccagctaccagcgggtcgatacttcggtcgctctcgaccgtctgaaccagcccggcatcgagaaggtcgtccagaaggacaaggagcagacgctccagatcgacctcaagaaccccgagcagttcaacggcaagtcgacgagcaagatcgaaacccagtatccgtacgaggtcacctctgatgtctggaaggccgtccagcaagccaaggacgcccagcggatcagcgggacgatcaacgcgacggtctccggcgacaacatcctcctcagcctgctgatcaacctgctgccgatcgccattctggtggtcctgctgctgctgttcatgtcgcagatgcagggtggcggctcgcgggtgctcaacttcggcaagtccaaggcgaagatgatcaccaaggacaccccgaagacgacgttcgccgacgtggcgggcgccgacgaggcggtcgaggagctccacgagatcaaggacttcctgcagaacccggcgaagtatcaggcgctcggcgccaagatcccgaagggtgtgctgctgttcggctccccgggtaccggtaagacgctgctggcccgcgcggtcgccggcgaggccggggtgccgttctactcgatctccgggtccgacttcgtggagatgttcgtcggtgtcggcgcgagccgggttcgtgacctcttcgagcaggccaagtcgaatgcgccggcgatcgtcttcgtcgacgagatcgacgccgtcggccggcaccgcggcgccggcatgggcggcggccacgacgagcgcgagcagacgctcaaccagctgctcgtcgagatggacggcttcgacaccaagggtggcgtgatcctgatcgcggccaccaaccggccggacatcctcgacccggcgctgctgcgcccgggccgtttcgaccggcagatcccggtggacaacccggacatggagggccgcaaggcgatcctgcgggtgcacgccaagggcaagccgttcacgcccgacgtcgacctcgactcggtggcccgtcgcacgcccggtttctccggcgccgacctggccaacgtgatcaacgaggccgcactgctgaccgcccggcacgagaagcgggcgatctccaacgagtacctcgaggaggcgatcgaccgggtcatcgccggccccgagcgtcgtacccgggcgatgagcgacaaggaaaagaagatcaccgcctaccacgagggtggacacgcgctggtggcctacgcgctgccgcactccgccccggtgcacaaggtgacgatcctcccgcgtggccgctcgctcgggcacaccctggtcctgccgaccgaggacaagtacacccagacccgcgccgagatgatcgacaccctggcgtacgcgctgggtggccgggccgccgaggagctcgtcttccacgagcccaccaccggcgccggcaacgacatcgagaaggcgtccggcctggcccgcgccatggtcacgcagtacggcatgagctccaagctcggcgccgtgaaatacggcaccagtggtgacgagcccttcatgggccgcaacatgggccacgagaaggactactcggacgccgtcgccgccgacatcgactccgaggtgcgggcgctcatcgagctcgcgcacgacgaggcctgggagatcctggtcgagtaccgcgacgttctcgacaacatggtcctggagctgatggagaaggagaccatcacccaggacgacatgaaccggatctgcgcccgggtgcagaagcgcccgccgatgtcgccgttcaacggcttcggcaagcgcctgccgtcggaggccccgccggtgctcactcccgccgagcgggagaagctgaaggcgcaggccgaagcggatggccagttcgctgtcggccccaacgccaacggcgccgtggaaggcagcatctgatcagcacgcacgacgacatcgactatctcgccgcccgactggtcgacggcaagctcaccggcaccccggtggagcaggccgtcgacctcgggcggatcgagaaagcggtccgggagatcctcatcgcgatcggtgaggaccccgaccgggatggtctcgcacgcaccccggcccgggtcgcccgcgcctacgccgagctgttcgccggcctgcgggtcgacccggcggaggtgctgaccaccaccttcgaggcggaccacgaggagctcgtgctggtccgcgacatcgaggtgcagagcatgtgcgagcaccacctgctgccgttcaagggcgtcgcgcacatcggctacatcccgggcgtcgacggacggatcaccgggctgtcgaaactggcccggctcgtcgaggtgttcgggcgacgcccacaggtgcaggaacgcctcacctcacagatcgccgacctgctgatggcgaagctgggggcgcgcggggtgatagtggtgctggagtgcgagcacctgtgcatggagatgcggggcatccgcaaggtgggcgcgcggacggtcacctcggcggtgcgcggcgccttccagaccgatggcaaggtccgcgccgaagctatggccctgatcaacgcgcgctgattttcggtgaccacccacgggcaatgaagggtcgcgatgatcgttatggccgcgcagcggcctgatcatcgcgacccggcctcggcgggagcggcgatcagttatcggccgcagcgcacgatatctgcatttcgctcttaaatcccgccgcgaaactgattggcggaatccatggcggcgcgggtcaactgggttgcctcgtcgagccgggcccgggcctgttccagatgggcgatagcggccgtcgccgccggatgaaacgacccgaccgtggtcaggcgcagcatcgcgagcgactgatcgagctggtcaccggccatctgaatgccggcgatcgcgcggtccgccccggacaccgagacggcgatgttcatctttatctcttcgacgctcgccattgtcctgtcctctccaggtttcagttcagcagttgttgcagaccgacacccatgcaggtgagcagcaccggggtgaggcacgcgacgatgccgacgaccggcgtgcgatcgaccggcggaccgcctttcgcggcgtccggaccccagacgaaaccgatcgtggcccaacccaggccgaatgccagcagcggcatgctcaggccgcagaggagcgtgtatgtcggcagcgaaccgctcggcgcgaccagatagagaatgatctgcacgaacagcacggccgccgcgaacggaccgtaaaccagaagattgcgcgcccaggggcgtcccgggccgagcggaatcggaccgatgaaagcgtgatcggcggcgtcggcggtaatcctggcttgctgcaacgccgccaggaccgcgtccgggccaccgattgtcgcggcctgcgcggtcgcacgttccccctccagggggagcagatctatttcgggcacgccgaaatcgcgcatcagccgggcacgctgcggcgccagccgggcccggaccgcggtgagctcctggcgtgccgcggcgatcgtggcagcctgctcgccggccgacgtgctggccgcccggcgcaccacgtcgagttgctgggcggccgccagataggccgcccagggactctccgggggtgcgccggcctgagcgggaaccagtccgctctgctctgcctgctccgtcatgggtgttcaccctccggctgtacgaacgggaccaccgtgaccgtgcgatcggtgtgacggtcgtgcagcagcgcccggttcggccgcggctgccagtcgaccgcccgccccagcatcagcgacacatccgcctgcggaacgttgaggaacagcaggccggccacatcctcgcggcccatgctgccgccggtctcctcactgaaccggcgcaccccccgccaccaggacagcaggtgcgcgccccggctcggaccctcgcgcagcagctgccgcaggccggtcagggcgcccggcggagcggcgtccatgccgaacaccacccgatagcccggctggtcgtcggcgagttcggcagccagcccggcggcatcggtcaccaccacctcctgccggtggctgatctccgcggccagggccgcggccagcgcgtcgccctcggcgaccagggagcagatcacgaagcgggcggtacgcggcgggtggcacgccgccacgctgcgcgccgccgcgtccaacacctcggaaccggccgcctgcgagcccaggatcgccaggtgccgccccggggaggaatccagggggaaggcggccgtcgacaggctcacgtcgatcatgcgaccgatcagggcggtggggcgactcgcccggccggccagggcggcccgataggtggggtcgtcgaccagatgctgatgcgcatacccggcgaagatccgcggcggcaccgcctccgggtcgcgggcaccccacagccggtgccgcaggttgctgagcgactcctgatcggcgtgcggatccgggaaccgaaccacccgttcgtgaccccgggtcgccccgcgggggccgcccagaccaccggccgtgttcaccacggcactgcccagcggcagaccggccgccgcgtcgttggtcggctccagcacgtcaccgccgcccggcagcgcgatccgcaccgggaactggccgaagatcgaatcccgtttggcgtagagagcttccaccccgagcaccgtctgactggccaggaccaggtgaatcccgtacgaccggcccttgcgcgccagcgactcgagcagtcccaccgcctcgctcgcggtcggatcgttgccggccagcagcacctggaactcgtcgatgacacagaggacccgcggcagcggccgcccgcgcccctcctccgccgccacggcgcgaagatcggcaaaccgggaaacaccggctcttttgtacgccatggaccgccggcccatctcggcatccaactcgcggagcaccgccaggccgtactcccgatccgactccaccccgaccgcacgggcatgcggcagccaggtgcggtcccggtgcgtcggcacgaactcggcgaaggacacgccctccttgaagtccagcaggtagagggccagctcgtcgggcgagtagcgggtgcccagcccgtacagcacgttgatcaggaaagcggtcttgccggcgcccgagcgcccaccgaccatccagtgcggggtcagatcgttgaaacgcagcaccagcggcacgtcgccgtgatgccccaccacggtttccacacccgcggacgcgtccgccgaccacagctcctcggacggctccggcagcaggtcggccagcgtcacccgggacgcggccgccgatcgggccgccagctcctgacagaccgcgtcgaccaggtgcgccggcggctcatcgtcgagcagaaccggggcgttcagccacggcgcttccggcgtcgacccgaacgatcccccgggcgggtcaccgaccacggcgaacggattccgcacactgatcgcggtggtccgcggcagcggcgcctgagtcgtctccgcggtcaacggcggcggcggccaaccggccacgatcaggtgcaaccccgactccggcccctgctgcgcgagagcggcgatccgacgcagctcctcgccctcggtgagctccggcagactggcgatgaccagcagcagcatccggtcccgtttggcccggcgggtctgccgcacactgtccgacccgaccccgcgggccggccgcagccacttctccgcctcggccagcacatcccgcagcccctgccggtccaccgccggcggcgacatcagcccggcatcggcgagctcctcgaacggttggaagaccgcacccccaccgatcccgtccaccgcccgcaccagcagcgaccccgccggagccgccgcgaaaagccgcagaagcagcgccctgatcagcccgaacacccgcggatcggtggcgctcgcatcgatcgtcaaatgcccggcacccagcagcggaacgatcgccggaaatcgaacctcatcagcgggtcggacctgtccgagatcaacgggttggggttgtccgagaccaacgggctggcgttgtccggaaccgacgggttgggactgcccgggaccgacgggcgggggctgtccaggaccgacggactgggactgtccggcaccagaaaggtgagccaccccgacccgcacgaaccgccccggttccgtccctccggcagcaacctgcgtccccgaaccgtcaagcggcatccgcgaagtcagcgcatccagcggcgcccccagccacccgggcgccacctgcgccgccgcctcccgcagccgctccgcaagccgctgctgctcccgcggatcagcggcgctgggcgcaaacgcctccagcgcggccgccgcagcatccgccgccgccaccgcctgccggtgcaaagcagcagcctgccggacccgcagagccgaatccgccactgctgtcacctcctgtcgcgcgcataaaacctatcccagaccagcccccctactcgcaatgcggtcccgccgaaccgctatgccgagctagctccgcgggtctccgggagagcgcccaccggccctcgatgatccatacacccgggcaatcccatcggttcggtccggcacaaggtcctctgcccgtgttaacacggcgatgacgaattagtgtttgaggtatgcagccgtctgagccgggacacgaaggaacgtcgaagttgccagccgggctaccagcgtctccgtcttggacccctgagcagttcgagcgctcttcgccttcgatccatccgtctgatccgtccaatgtcggagtcttgaagcgacgtagacgtagcggccgcctgagcactcggagggggaggctgtggcttgccctgggtgccggagtcgtggtgctgctatgtctgggtgccgtgggtgtcatcgtcgcgctctacgatagtgcgacggaagtgaagcgctcagaaccggatgtcgtcgtagacagcttcctgcgcgcatatcttgtgaatcgcgacgacaatgaagcggcgctgtatgaatgcaagcccggaagcacccttgctcaaatagcaagctaccggagccaggtcttgtccgatgagaagaaattttctctgggaattcgggtaacctggacgagtctccaggtgtcggaccagagtggcagcaccacagttacaacgcaaatccatcgcgccttcgctgatggaagcgaacgtgcgactgataattggatcttcgggatgcaaaatcaggatggttggcgtgtatgcgatgcgaggcgtacatcctagctcattccaaccacaatgagtggactggcacctctagggttcgcggcgtcttcccgctccaggaccacgcataccagtcaagctcatccgccactcgtgcgcagatatcgccgctcccactgctatacaattcggtcgttgcccgaagatctcgctgacaagtcccatcatcaaggactcgaatcaatctatgtccagtgattcgtgaggactgtgctgccattatggggaggcgccggggaggatcgtcgagagaaactaatctgactggccctgaggccgcggattcaaacaccgtagccaaaccatactcttcgacccagacgcgatctatcggcacaagggctgcaaatacttccgttccttccgactccgcgcgataaaactccgcttcgcgcatgacgggtacgtaagtacggctgccctgcacggtcttctcgtccgcgcgcaagtcacttcgccacccaagtcccggggcaccgattatgactcgacgaccccgcagcgggccagtcatggctgctggaatgggaacgatcggttgcggagtttcggtgggccagcttgaactgttcgcgaagggatctggctcgtggcgttggttcactctgcgccacccaatggagcgcccaccttctgcatgaacgggacggggtttatggcgccattactagatcggtcataattaagatgcacttcgaaatgcagatgtggccccgatgaattgccgctagttccgactcggccgattacttggccggccgtcaccttctgattcacgtgcacgaaaggcatttggaccatgtgacagtagcgagtcatgatgttgcctgcatgctggatttcgaccatccacccgcagccgcccttgccaggatagccatccacgtcgcaggtttttcgccctttaaaatcctcatcgcatttcacgacggacacgatcccgctagcggcggcgaggattggcgtgtatctgccgacgattagatctacgccttggtggttgggtcggtcgggcccgcggaagccggatcctacaatcgcttttactggaattgtccagcctgatgctgctatttggccagcccgtgcacaattcattgccagagagttgccaaccgcatttgctgcgccatgggctaatagattgaccatctgggttgcggccggctcgtgtttagcataagcatctgggtacgcactgatctgaacggcctgcgcggctcgagtcagtgacatattttcccaaccctggatagtcttcaacttctcatagaacttggtagcggcatattcagggtcctggagctgtgctggctttccccagcccgaactaggcctctgctggaaaagccccaatgagtcgtggtcgtttcgtgaccctaggttgcctagattggataggccggattcctgcatcgcggttgctacggcgataacccaggcgcgaggaggcattttcagcgcagccccgacgttgacgatcactgcggcattgtggacctgctgagaaccgtattgtcgaacttggggaagtttgccacctagggcgatcggcccaccctgtccgcatccaaaagaggcggtgtttgtggatgtctgatcgcgcctcttactgatttcgccgaataccagaaaagtgatactgcctccgcagcacaacaatgccaacgtggtcacgacggcagtaagcaagacggctttcttggacgccctgaatttcatgtcgcttcccagtcgatgccgtcaaccagccagtgtccgctcgatgcgatcagacgaagactcaatcttcccttgtccatcgtgacggctgcattaacttgcgtctcattaacgacctcgagggtgggccgcccaatgacctggttagctggcacgccagcaggatctgctccgcgaagttgattctcgaggtcagttgtagcgttcggcagtaggcgatctaaccaagccttcgacgtgaccccggtatgactggcccatgcagatgcaaatgcgtaagcaaccgcctccggctgagctcggcccgggctggttctaggttttggaggaggatcggacgatatgacgctgtcatcttcagacggatcgatgcttaccgtaacactgggcggattaagaccagcgatcggcgagttgctgtttccgctagatagcagccgtccaacgccgaccacggccattactacggttacaagcacgagtgcgacaccccaacggctacggaaaagtgcgttgagaacgcgcgcgacgatcgccgacacttgtcacctcgcctcggagcgcacccgtggagtcgccggttcctgaattgtcgccccagtagacggtcgatagatggtgtacgacgctggggtctctgtggcctccggctctgcccactcggtacgcctaggtcggttccggctctgagaaggctgactcgtgccggctatagaatgagcactggcagcggcttcaccatgtacgacctcgctaccgtccggacgaatttgcatcggcgggtgcgcggggagccctcgttcaaccacattggaatgggcagtatttattgctgtatgcgtcgagtcttcgaggcgggcttccggacgtaagtcgcgtgtttcggcacggaccacacggctattctttccaaaatttgctggggagccggcgccttcagcggcctccaatttggcagcttcgcgcatatcgcgaaagaagcggcgatgccaggagccccccgaagcgatagccgcagcgttatccttgccgcccaattgcgtaattctacggtacgggcgtaggagaagccatccgacgacgccacagagccaaaccaatacgacctgcagccaaccggccaaactcgcggtattcatgatgagatcgactgcgaataaatatatggcagcccctgtgccgaatatggccacattaaaaacggctgccacaacggcattgcctaggcgccggattcctgcactagccgggcgaagaaggccaacggttcctaggatgggtgctgcaatcactgcccaacgaaatatcaagaatccaagtaggacaaggatcgaggcggtaaggtcgaacattgcaaacatgaccgcagcgaggacggcgatgaacccagcaccgactcgttccatgccgttctttccctgaagatattcgtatgcttccgggtcttccttactgatctgttcggctaccttcttccactgctctttttttccgttgaggatgccatcgcgggttccggggttgtctcggatgcgctgtgcttcgtcccatgttagtgagcgagcgtcgtatagtgcagcgccgtattttttggcggtatcgctgtcggccgagccaagaactccacgcagccaattacgatagagcatagtctccgtggcggtgtcactagcgcgcacggctggtggccgctgatcctcacatgaggttggcttcaggcgacatccgttaccaccactttgcgggcgaggtccgacggcatcgtggacaacacctagcgtggtgaccaaggtttgatccgcaagattagctgatctaactggccaagcggcgattgctgttacggcaaccattaccaagattgcccatccggcggttgttgttgcagcgcccatgtcagcttggcgtgaacgccatatcaggtaaaggccaactatcgcgagcgtgatcacgccgaatacgctaaataccttttcgtaaaccgctttggtcgcttggtctaccagagggtcggcccagccccacattgttgccgggtcccaggctcgctcccttagcgcgttagaggcgccgattacggccgtggcgaccataagctcgccatttgccatagtattctcgatgccggtgtctgcatttacggcaccggcagcgcaaccgccgtctagatcatatgtattgtagctgtatccggcgtacccgtactcgctatatattccctgaggtccatcttttgtggatgactgcggacgctccgcaaaccatccggcaaggcctgaatccggcgtactgggagtcggagggtctaggcaatctacccggttgccagccaccttctccagtcggtcgacgcagcctttgaggtcattcttccattcctcaatgctgcacgcccctgaaggggctttcgatgggacggcgtatgcgctggctggggtggcgactgcccaagcgattgaggccgccacgatcactacgaggactgagagaaacgcaaccccccgccgcagcattttaggcctccaggtcggacgggagaggggccaactggggctgggctgggcctggggtggtgtccaggtgttccaggaggccttcgacgtaggagacgtcgacccggaccttctgcacccggccgtccacatcccgcatcacgaactcccggaagccgaggcggtgctgggacgacgtgtccacctgggacagggacgccagggtggcctcgtaaccgtcgtggaccgggacccgcagcaaccggagggcttcggaggcgatttcctggtcctcggcgatgcggccgacgaagacggtggagaccaggttctgcacgtccaggccgaggatgtctcgggggttctggga
